United States Patent
Kinoshita et al.

(10) Patent No.: US 11,072,666 B2
(45) Date of Patent: *Jul. 27, 2021

(54) CELL INJURY INDUCING THERAPEUTIC DRUG FOR USE IN CANCER THERAPY

(71) Applicant: CHUGAI SEIYAKU KABUSHIKI KAISHA, Tokyo (JP)

(72) Inventors: Yasuko Kinoshita, Kanagawa (JP); Yumiko Kawai, Kanagawa (JP); Toshiaki Tsunenari, Kanagawa (JP); Takahiro Ishiguro, Tokyo (JP); Mika Endo, Kanagawa (JP); Yuji Sano, Kanagawa (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 202 days.

This patent is subject to a terminal disclaimer.

(21) Appl. No.: 16/083,975

(22) PCT Filed: Feb. 24, 2017

(86) PCT No.: PCT/JP2017/007033
§ 371 (c)(1),
(2) Date: Sep. 11, 2018

(87) PCT Pub. No.: WO2017/159287
PCT Pub. Date: Sep. 21, 2017

(65) Prior Publication Data
US 2020/0048361 A1    Feb. 13, 2020

(30) Foreign Application Priority Data

Mar. 14, 2016  (JP) .............................. JP2016-050095

(51) Int. Cl.
| | | |
|---|---|---|
| C07K 16/30 | (2006.01) | |
| A61P 35/00 | (2006.01) | |
| A61K 39/395 | (2006.01) | |
| C07K 16/22 | (2006.01) | |
| C07K 16/28 | (2006.01) | |
| A61K 45/06 | (2006.01) | |
| A61K 39/00 | (2006.01) | |

(52) U.S. Cl.
CPC ........ *C07K 16/303* (2013.01); *A61K 39/3955* (2013.01); *A61K 39/39558* (2013.01); *A61K 45/06* (2013.01); *A61P 35/00* (2018.01); *C07K 16/22* (2013.01); *C07K 16/2809* (2013.01); A61K 2039/505 (2013.01); C07K 2317/31 (2013.01); C07K 2317/73 (2013.01); C07K 2317/92 (2013.01)

(58) Field of Classification Search
CPC .............. C07K 16/468; C07K 2317/31; C07K 16/2809
See application file for complete search history.

(56) References Cited

U.S. PATENT DOCUMENTS

| | | |
|---|---|---|
| 5,322,678 A | 6/1994 | Morgan, Jr. et al. |
| 5,585,097 A | 12/1996 | Bolt et al. |
| 5,624,821 A | 4/1997 | Winter et al. |
| 5,639,641 A | 6/1997 | Pedersen et al. |
| 5,648,260 A | 7/1997 | Winter et al. |
| 5,795,965 A | 8/1998 | Tsuchiya et al. |
| 5,990,286 A | 11/1999 | Khawli et al. |
| 6,025,165 A | 2/2000 | Whitlow et al. |
| 6,126,980 A | 10/2000 | Smith et al. |
| 6,329,511 B1 | 12/2001 | Vasquez et al. |
| 6,485,943 B2 | 11/2002 | Stevens et al. |
| 6,677,436 B1 | 1/2004 | Sato et al. |
| 6,737,056 B1 | 5/2004 | Presta |
| 6,884,879 B1 | 4/2005 | Baca et al. |
| 6,913,747 B1 | 7/2005 | Co et al. |
| 7,052,873 B2 | 5/2006 | Tsuchiya |
| 7,276,585 B2 | 10/2007 | Lazar et al. |
| 7,358,054 B2 | 4/2008 | Lyne et al. |
| 7,365,166 B2 | 4/2008 | Baca et al. |
| 7,572,456 B2 | 8/2009 | Johnson et al. |
| 7,615,213 B2 | 11/2009 | Kasaian et al. |
| 7,736,652 B2 | 6/2010 | Penichet et al. |

(Continued)

FOREIGN PATENT DOCUMENTS

| | | |
|---|---|---|
| CA | 2647846 A1 | 10/2007 |
| CA | 2700986 A1 | 4/2009 |

(Continued)

OTHER PUBLICATIONS

Shirakawa et al., Int J Oncol; 34:649-56 (Year: 2009).*
Feng & Ho, FEBS Lett 588(2):377-382 (Year: 2014)*
Corrected NPL48: Alignment of Fc domain sequences of catumaxomab and SEQ ID Nos. 23, 24, 25, and 26, cited in Oppositions to European Patent No. 2647707 on May 31, 2019 and Jun. 12, 2019. (Year: 2019)*
Corrected NPL84: Sequence Alignments cited in Oppositions of European Patent No. 2647707 on May 31, 2019 and June 12, 2019. (Year: 2019)*
Alarcon et al., EMBO J. Apr. 1991; 10(4):903-12.

(Continued)

*Primary Examiner* — Jessica H Roark
(74) *Attorney, Agent, or Firm* — Nixon & Vanderhye P.C.

(57) ABSTRACT

The present invention provides anticancer agents comprising as an active ingredient a bispecific antibody that comprises a domain comprising a glypican 3-binding antibody variable region, a domain comprising a T cell receptor complex-binding antibody variable region, and common L chains that can enhance the affinity for the two antigens, as well as pharmaceutical compositions comprising the bispecific antibody as an active ingredient, the compositions being for use in combination with other anticancer agents. The bispecific antibodies are novel molecules which are produced with high efficiency and have strong anti-tumor activity as well as safety and excellent pharmacodynamics. The bispecific antibodies can be expected to be applied to various cancers.

17 Claims, 47 Drawing Sheets

Specification includes a Sequence Listing.

(56) References Cited

U.S. PATENT DOCUMENTS

| | | |
|---|---|---|
| 7,955,590 B2 | 6/2011 | Gillies et al. |
| 8,062,635 B2 | 11/2011 | Hattori et al. |
| 8,101,186 B2 | 1/2012 | Mezo et al. |
| 8,337,841 B2 | 12/2012 | Kojima |
| 8,388,955 B2 | 3/2013 | Lazar et al. |
| 8,497,355 B2 | 7/2013 | Igawa et al. |
| 8,586,713 B2 | 11/2013 | Davis et al. |
| 8,592,562 B2 | 11/2013 | Kannan et al. |
| 8,735,545 B2 | 5/2014 | Lazar et al. |
| 8,871,912 B2 | 10/2014 | Davis et al. |
| 9,067,986 B2 | 6/2015 | Gurney et al. |
| 9,096,651 B2 | 8/2015 | Igawa et al. |
| 9,212,230 B2 | 12/2015 | Schuurman et al. |
| 9,228,017 B2 | 1/2016 | Igawa et al. |
| 9,527,926 B2 | 12/2016 | Ho et al. |
| 9,556,279 B2 | 1/2017 | Niwa et al. |
| 9,637,557 B2 | 5/2017 | Scheer et al. |
| 9,670,269 B2 | 6/2017 | Igawa et al. |
| 9,688,762 B2 | 6/2017 | Igawa et al. |
| 9,828,429 B2 | 11/2017 | Igawa et al. |
| 9,975,966 B2 | 5/2018 | Nezu et al. |
| 10,011,858 B2 | 7/2018 | Igawa et al. |
| 10,053,513 B2 | 8/2018 | McCarthy et al. |
| 10,435,458 B2 | 10/2019 | Kuramochi et al. |
| 10,759,870 B2 | 9/2020 | Teranishi et al. |
| 2002/0137897 A1 | 9/2002 | Stevens et al. |
| 2002/0142374 A1 | 10/2002 | Gallo et al. |
| 2002/0164339 A1 | 11/2002 | Do Couto et al. |
| 2003/0078385 A1 | 4/2003 | Arathoon et al. |
| 2003/0103970 A1 | 6/2003 | Tsuchiya |
| 2003/0187225 A1 | 10/2003 | Penichet et al. |
| 2003/0207346 A1* | 11/2003 | Arathoon ............... C07K 16/46 435/69.1 |
| 2003/0224397 A1 | 12/2003 | Lowman et al. |
| 2004/0002587 A1 | 1/2004 | Watkins et al. |
| 2004/0081651 A1 | 4/2004 | Lyne Pd et al. |
| 2004/0236080 A1 | 11/2004 | Aburatani et al. |
| 2005/0095243 A1 | 5/2005 | Chan et al. |
| 2005/0118174 A1 | 6/2005 | Presta |
| 2005/0130224 A1 | 6/2005 | Saito et al. |
| 2005/0244403 A1 | 11/2005 | Lazar et al. |
| 2005/0261229 A1 | 11/2005 | Gillies et al. |
| 2006/0019342 A1 | 1/2006 | Dall'Acqua et al. |
| 2006/0057149 A1 | 3/2006 | Johnson et al. |
| 2006/0063228 A1 | 3/2006 | Kasaian et al. |
| 2006/0074225 A1 | 4/2006 | Chamberlain |
| 2006/0159673 A1 | 7/2006 | Kokima |
| 2006/0204493 A1 | 9/2006 | Huang et al. |
| 2006/0235208 A1 | 10/2006 | Lazar et al. |
| 2006/0275282 A1 | 12/2006 | Moore et al. |
| 2007/0036785 A1 | 2/2007 | Kishimoto et al. |
| 2007/0041978 A1 | 2/2007 | Hattori et al. |
| 2007/0059312 A1 | 3/2007 | Baca et al. |
| 2007/0178092 A1 | 8/2007 | Bolt et al. |
| 2007/0224188 A1 | 9/2007 | Allan et al. |
| 2007/0231329 A1 | 10/2007 | Lazar et al. |
| 2007/0248602 A1 | 10/2007 | Lazar et al. |
| 2007/0254831 A1 | 11/2007 | Mezo et al. |
| 2007/0287170 A1 | 12/2007 | Davis et al. |
| 2008/0166756 A1 | 7/2008 | Tsuchiya et al. |
| 2008/0317758 A9 | 12/2008 | Presta |
| 2009/0263392 A1 | 10/2009 | Igawa et al. |
| 2009/0324589 A1 | 12/2009 | Igawa et al. |
| 2010/0015133 A1 | 1/2010 | Igawa et al. |
| 2010/0105874 A1 | 4/2010 | Schuurman et al. |
| 2010/0178298 A1 | 7/2010 | Lindhofer |
| 2010/0221252 A1 | 9/2010 | Bigler et al. |
| 2010/0239577 A1 | 9/2010 | Igawa et al. |
| 2010/0286374 A1 | 11/2010 | Kannan et al. |
| 2010/0291072 A1 | 11/2010 | Lowman et al. |
| 2010/0298542 A1 | 11/2010 | Igawa et al. |
| 2010/0331527 A1 | 12/2010 | Davis et al. |
| 2011/0021755 A1 | 1/2011 | Lazar et al. |
| 2011/0123532 A1 | 5/2011 | Gurney et al. |
| 2011/0236374 A1 | 9/2011 | Shitara et al. |
| 2011/0245473 A1 | 10/2011 | Igawa et al. |
| 2011/0287009 A1 | 11/2011 | Scheer et al. |
| 2012/0009188 A1 | 1/2012 | Behrens |
| 2012/0010387 A1 | 1/2012 | Niwa et al. |
| 2012/0021409 A1 | 1/2012 | McWhirter et al. |
| 2012/0065379 A1 | 3/2012 | Igawa et al. |
| 2012/0149876 A1 | 6/2012 | Von Kreudenstein et al. |
| 2013/0011866 A1 | 1/2013 | Igawa et al. |
| 2013/0018174 A1 | 1/2013 | Igawa et al. |
| 2013/0039913 A1 | 2/2013 | Labrijn et al. |
| 2013/0101581 A1 | 4/2013 | Kuramochi et al. |
| 2013/0115208 A1 | 5/2013 | Ho et al. |
| 2013/0195849 A1 | 8/2013 | Spreter Von Kreudenstein et al. |
| 2014/0112914 A1* | 4/2014 | Nezu ..................... A61P 1/16 424/133.1 |
| 2014/0303356 A1 | 10/2014 | Gramer et al. |
| 2014/0370020 A1 | 12/2014 | Kuramochi et al. |
| 2015/0315278 A1 | 11/2015 | Igawa et al. |
| 2015/0337053 A1 | 11/2015 | McCarthy et al. |
| 2016/0229915 A1 | 8/2016 | Igawa et al. |
| 2017/0022287 A1 | 1/2017 | Igawa et al. |
| 2017/0260271 A1 | 9/2017 | Igawa et al. |
| 2017/0267783 A1 | 9/2017 | Nezu et al. |
| 2018/0051307 A1 | 2/2018 | Igawa et al. |
| 2018/0057607 A1 | 3/2018 | Igawa et al. |
| 2018/0142027 A1 | 5/2018 | Igawa et al. |
| 2018/0192623 A1 | 7/2018 | Jishage et al. |
| 2018/0244805 A1 | 8/2018 | Nezu et al. |
| 2019/0077872 A1 | 3/2019 | Igawa |
| 2019/0352421 A1 | 11/2019 | Adams et al. |
| 2020/0048361 A1 | 2/2020 | Kinoshita et al. |
| 2020/0087380 A1 | 3/2020 | Kuramochi et al. |
| 2020/0223940 A1 | 7/2020 | Teranishi et al. |
| 2020/0354473 A1 | 11/2020 | Teranishi et al. |

FOREIGN PATENT DOCUMENTS

| | | |
|---|---|---|
| CA | 2819530 A1 | 6/2012 |
| CN | 1842540 A | 10/2006 |
| CN | 101198698 | 6/2008 |
| CN | 1018740 A | 10/2010 |
| CN | 102471378 | 5/2012 |
| CN | 1842540 B | 7/2012 |
| CN | 102782131 | 11/2012 |
| CN | 102946906 | 2/2013 |
| CN | 103429737 A | 12/2013 |
| CN | 103833852 A | 6/2014 |
| CN | 101874042 B | 9/2018 |
| EP | 0329185 A2 | 8/1989 |
| EP | 0329185 B1 | 4/1994 |
| EP | 0783893 A1 | 7/1997 |
| EP | 0811691 A1 | 12/1997 |
| EP | 1069185 A1 | 1/2001 |
| EP | 1378520 A1 | 1/2004 |
| EP | 0811691 B1 | 12/2004 |
| EP | 1605058 A1 | 12/2005 |
| EP | 06730751.2 | 3/2006 |
| EP | 1674111 A1 | 6/2006 |
| EP | 1773391 A2 | 4/2007 |
| EP | 1870458 A1 | 12/2007 |
| EP | 1870459 | 12/2007 |
| EP | 1870459 A1 | 12/2007 |
| EP | 1900814 A1 | 3/2008 |
| EP | 2006381 A1 | 12/2008 |
| EP | 2009101 A1 | 12/2008 |
| EP | 1605058 B1 | 5/2009 |
| EP | 2194006 A1 | 6/2010 |
| EP | 2194066 | 6/2010 |
| EP | 2202245 A1 | 6/2010 |
| EP | 09176465.4 | 6/2010 |
| EP | 1674111 B1 | 11/2010 |
| EP | 1069185 B1 | 6/2011 |
| EP | 0783893 B1 | 4/2012 |
| EP | 2445936 A1 | 5/2012 |
| EP | 2543727 | 1/2013 |
| EP | 2543730 A1 | 1/2013 |
| EP | 2576621 A1 | 4/2013 |
| EP | 11722423.8 | 4/2013 |
| EP | 2647707 A1 | 10/2013 |

(56) References Cited

FOREIGN PATENT DOCUMENTS

| | | |
|---|---|---|
| EP | 11845786.0 | 10/2013 |
| EP | 2194006 B1 | 1/2014 |
| EP | 2698431 A1 | 2/2014 |
| EP | 2905290 A1 | 8/2015 |
| EP | 2914634 A1 | 9/2015 |
| EP | 1870459 B1 | 6/2016 |
| EP | 3199628 A1 | 8/2017 |
| EP | 2647707 B1 | 9/2018 |
| EP | 2543730 B1 | 10/2018 |
| EP | 2576621 B1 | 4/2019 |
| EP | 2698431 B1 | 9/2020 |
| JP | H0228200 A | 1/1990 |
| JP | H03500644 A | 2/1991 |
| JP | H0767688 A | 3/1995 |
| JP | H08500979 A | 2/1996 |
| JP | H11500915 A | 1/1999 |
| JP | H11500916 A | 1/1999 |
| JP | 2004086862 A | 3/2004 |
| JP | 2004511426 A | 4/2004 |
| JP | 3590070 B2 | 11/2004 |
| JP | 2005501514 | 1/2005 |
| JP | 3697555 B2 | 9/2005 |
| JP | 2005535341 A | 11/2005 |
| JP | 3775798 B2 | 5/2006 |
| JP | 2009527499 A | 7/2009 |
| JP | 2010522701 A | 7/2010 |
| JP | 2010532369 A | 10/2010 |
| JP | 2011508604 A | 3/2011 |
| JP | 2012504970 A | 3/2012 |
| JP | 2012082201 A | 4/2012 |
| JP | 2012522527 A | 9/2012 |
| JP | 5144499 B2 | 2/2013 |
| JP | 5171948 B2 | 3/2013 |
| JP | 2013529084 A | 7/2013 |
| JP | 2013529190 A | 7/2013 |
| JP | 2013165716 A | 8/2013 |
| JP | 5334319 B2 | 11/2013 |
| JP | 5616428 B2 | 10/2014 |
| JP | 5681482 B2 | 3/2015 |
| JP | 2015130883 A | 7/2015 |
| JP | 5882247 B2 | 3/2016 |
| JP | 5912436 B2 | 4/2016 |
| JP | 6022444 B2 | 11/2016 |
| JP | 6048972 B2 | 12/2016 |
| JP | 6157046 B2 | 7/2017 |
| JP | 6175590 B1 | 8/2017 |
| JP | 6534615 B2 | 6/2019 |
| KR | 20080013875 A | 2/2008 |
| KR | 20090107091 A | 10/2009 |
| KR | 20100056467 A | 5/2010 |
| KR | 20130130765 A | 12/2013 |
| KR | 101374454 B1 | 3/2014 |
| MX | 2013006100 A | 7/2013 |
| MX | 349057 B | 7/2017 |
| RU | 2003130072 A | 4/2005 |
| RU | 2266298 C2 | 12/2005 |
| RU | 2006104842 A | 8/2007 |
| RU | 2355705 C2 | 5/2009 |
| RU | 2009149451 A | 7/2011 |
| RU | 2427588 C2 | 8/2011 |
| RU | 2012112067 A | 10/2013 |
| RU | 2519669 C2 | 6/2014 |
| RU | 2570639 C2 | 12/2015 |
| SG | 11201701119 R | 3/2017 |
| TW | 200722517 | 6/2007 |
| TW | 201249872 A | 12/2012 |
| TW | 201602132 A | 1/2016 |
| TW | I597290 | 9/2017 |
| WO | WO-8901343 A1 | 2/1989 |
| WO | WO-9219759 A1 | 11/1992 |
| WO | WO-9405690 A1 | 3/1994 |
| WO | WO-9611020 A1 | 4/1996 |
| WO | WO-9612503 A1 | 5/1996 |
| WO | WO 9627011 | 9/1996 |
| WO | WO-9627011 A1 | 9/1996 |
| WO | WO-9710354 A1 | 3/1997 |
| WO | WO-9803546 A1 | 1/1998 |
| WO | WO 9850431 | 11/1998 |
| WO | WO-9850431 A2 | 11/1998 |
| WO | WO-9918212 A1 | 4/1999 |
| WO | WO-9951743 A1 | 10/1999 |
| WO | WO-9958572 A1 | 11/1999 |
| WO | WO-0018806 A1 | 4/2000 |
| WO | WO-0042072 A2 | 7/2000 |
| WO | WO-0130854 A2 | 5/2001 |
| WO | WO-0182899 A2 | 11/2001 |
| WO | WO-0190192 A2 | 11/2001 |
| WO | WO-03000883 A1 | 1/2003 |
| WO | WO-03012069 A2 | 2/2003 |
| WO | WO-03020949 A2 | 3/2003 |
| WO | WO-03035835 A2 | 5/2003 |
| WO | WO-03074679 A2 | 9/2003 |
| WO | WO-2004003019 A2 | 1/2004 |
| WO | WO-2004016740 A2 | 2/2004 |
| WO | WO-2004035607 A2 | 4/2004 |
| WO | WO-2004065611 A1 | 8/2004 |
| WO | WO-2004068931 A2 | 8/2004 |
| WO | WO-2004096273 A1 | 11/2004 |
| WO | WO-2004099249 A2 | 11/2004 |
| WO | WO-2005000900 A1 | 1/2005 |
| WO | WO-2005035756 A1 | 4/2005 |
| WO | WO-2005047327 A2 | 5/2005 |
| WO | WO-2005059106 A2 | 6/2005 |
| WO | WO-2005062916 A2 | 7/2005 |
| WO | WO-2005063815 A2 | 7/2005 |
| WO | WO-2005067620 A2 | 7/2005 |
| WO | WO 2002060919 | 8/2005 |
| WO | WO-2005112564 A2 | 12/2005 |
| WO | WO-2005118635 A2 | 12/2005 |
| WO | WO-2005121180 A1 | 12/2005 |
| WO | WO-2005123126 A2 | 12/2005 |
| WO | WO-2006004663 A2 | 1/2006 |
| WO | WO 2006019447 | 2/2006 |
| WO | WO-2006020114 A2 | 2/2006 |
| WO | WO-2006030200 A1 | 3/2006 |
| WO | WO-2006030220 A1 | 3/2006 |
| WO | WO-2006050491 A2 | 5/2006 |
| WO | WO-2006067913 A1 | 6/2006 |
| WO | WO-2006105338 A2 | 10/2006 |
| WO | WO-2006106903 A1 | 10/2006 |
| WO | WO 2006106905 | 10/2006 |
| WO | WO 2006109592 | 10/2006 |
| WO | WO-2006121852 A2 | 11/2006 |
| WO | WO-2007024535 A2 | 3/2007 |
| WO | WO-2007060411 A1 | 5/2007 |
| WO | WO 2007114319 | 10/2007 |
| WO | WO-2007114325 A1 | 10/2007 |
| WO | WO-2007145941 A2 | 12/2007 |
| WO | WO 2007147901 | 12/2007 |
| WO | WO-2007147901 A1 | 12/2007 |
| WO | WO-2008090960 A1 | 7/2008 |
| WO | WO-2008118970 A2 | 10/2008 |
| WO | WO-2008119353 A1 | 10/2008 |
| WO | WO 2008145142 | 12/2008 |
| WO | WO-2009012394 A1 | 1/2009 |
| WO | WO-2009041613 A1 | 4/2009 |
| WO | WO 2009041643 | 4/2009 |
| WO | WO-2009053368 A1 | 4/2009 |
| WO | WO-2009080252 A1 | 7/2009 |
| WO | WO-2009080253 A1 | 7/2009 |
| WO | WO 2009089004 | 7/2009 |
| WO | WO-2009120922 A2 | 10/2009 |
| WO | WO-2009125825 A1 | 10/2009 |
| WO | WO-2009134776 A2 | 11/2009 |
| WO | WO-2010034441 A1 | 4/2010 |
| WO | WO-2010042904 A2 | 4/2010 |
| WO | WO-2010085682 A2 | 7/2010 |
| WO | WO-2010102251 A2 | 9/2010 |
| WO | WO-2010106180 A2 | 9/2010 |
| WO | WO-2010107109 A1 | 9/2010 |
| WO | WO-2010115589 A1 | 10/2010 |
| WO | WO 2010120561 | 10/2010 |
| WO | WO 2010129304 | 11/2010 |
| WO | WO 2010151792 | 12/2010 |

(56) References Cited

FOREIGN PATENT DOCUMENTS

| WO | WO-2010151792 A1 | 12/2010 |
|---|---|---|
| WO | WO-2011147986 A1 | 1/2011 |
| WO | WO-2011025964 A2 | 3/2011 |
| WO | WO-2011108502 A1 | 9/2011 |
| WO | WO-2011108714 A1 | 9/2011 |
| WO | WO-2011111007 A2 | 9/2011 |
| WO | WO-2011131746 A2 | 10/2011 |
| WO | WO 2011133886 | 10/2011 |
| WO | WO-2011143545 A1 | 11/2011 |
| WO | WO-2012020096 A1 | 2/2012 |
| WO | WO 2012073985 | 6/2012 |
| WO | WO-2012073985 A1 | 6/2012 |
| WO | WO-2013060867 A2 | 5/2013 |
| WO | WO 2013065708 | 5/2013 |
| WO | WO 2013124450 | 8/2013 |
| WO | WO-2013157954 A1 | 10/2013 |
| WO | WO-2013158856 A2 | 10/2013 |
| WO | WO-2013181543 A1 | 12/2013 |
| WO | WO-2014028354 A1 | 2/2014 |
| WO | WO-2014051433 A1 | 4/2014 |
| WO | WO-2014054804 A1 | 4/2014 |
| WO | WO-2014067011 A1 | 5/2014 |
| WO | WO 20151046467 | 4/2015 |
| WO | WO 20151046554 | 4/2015 |
| WO | WO 20151156268 | 10/2015 |
| WO | WO 20151174439 | 11/2015 |
| WO | WO 2016/047722 | 3/2016 |
| WO | WO 2016047722 | 3/2016 |
| WO | WO 2016159213 | 10/2016 |
| WO | WO 20171159287 | 9/2017 |
| WO | WO-2019131988 A1 | 7/2019 |

OTHER PUBLICATIONS

Amann, et al., Cancer Immunol Immunother. Jan. 2009; 58(1):95-109. doi: 10. 1007Is00262-008-0529-y. Epub Jul. 2, 2008.

Buque, et al., Oncoimmunology. Mar. 2, 2005; 4(4):e1008814. eCollection 2015.

Campoli, et al., Clin Cancer Res. Jan. 1, 2010; 16(1):11-20. doi: 10. 1158/1078-0432.CCR-09-2345. Epub Dec. 22, 2009.

Chan, et al., Nat Rev Immunol. May 2010; 10(5):301-16. doi: 10. 1038/nri2761.

Choi, et al., Mol Immunol Jun. 2015; 65(2):377-83.

Cruse, et al. Atlas of Immunology, CRC Press LLC, 2004, excerpt from Chapter 3: p. 109.

De Gast, et al., Cancer Immunol Immunother. Jun. 1995; 40(6):390-6.

Decision dated Jul. 25, 2018 revoking the European Patent No. EP2006381, cited in the Ground of Appeal filed Dec. 4, 2018 by proprietor, Chugai Seiyaku Kabushiki Kaisha, in connection with formal appeal lodged on Sep. 19, 2018.

Declaration of Dr. Anette Henriksen dated Apr. 17, 2019, submitted by Opponent during European Patent Office opposition for EP2006381.

Feige et al. Trends Biochem Sci. Apr. 2010; 35(4):189-98. doi: 10.1016/j.tibs.2009.11.005. Epub Dec. 21, 2009.

Final Office Action dated Oct. 19, 2018 in U.S. Appl. No. 15/024,063, filed Mar. 23, 2016.

Goulet, et al., J Biol Chem. Jan. 12, 2018; 293(2):651-661.

Hess, et al., Future Oncol. Jan. 2012; 8(1):73-85. doi: 10. 2217lfan. 11.138.

Hinton, et al., J Biol Chem. Feb. 20, 2004; 279(8):6213-6.

International Preliminary Report on Patentability dated Sep. 27, 2018 in International Appl. No. PCT/JP2017/007033.

Iwai, et al., Igan Chiryoyaku, Yakkyoku, Jan. 5, 2016; 67(1):138-41.

Jefferis, et al., Immunol Lett. Jun. 3, 2002; 82(1-2):57-65.

Jones, et al., Endocr Relat Cancer. Dec. 2006; 13 Suppl 1:S45-51.

Klinger, et al., Immunol Rev. Mar. 2016; 270(1):193-208. dai: 10. 1111 I i mr. 12393.

Kontermann, et al., MAbs. Mar.-Apr. 2012; 4(2):182-97. doi: 10.4161/mabs. 4. 2.19000. Epub Mar. 31, 2012.

Larkin, et al., N Engl J Med. Jul. 2, 2015; 373(1):23-34. doi: 10. 1056INEJMaa1504030. Epub May 31, 2015.

Lazar, et al., Proc Natl Acad Sci U.S.A. Mar. 14, 2006; 103(11):4005-10.

Merchant, et al., Nat Biotechnol. Jul. 1998; 16(7):677-81.

Mezzanzanica, et al., Int J Cancer. Apr. 15, 1988; 41(4):609-15.

Natsume, et al., Drug Des Devel Ther. Sep. 21, 2009; 3:7-16.

Nimmerjahn, et al., Nat Rev Immunol. Jan. 2008; 8(1):34-47.

Pavlou, et al., Eur J Pharm Biopharm. Apr. 2005; 59(3):389-96.

Radaev, et al., J Biol Chem. May 11, 2001; 276(19):16469-77. Epub Jan. 31, 2001.

Reichert, et al., Nat Biotechnol. Sep. 2005; 23(9):1073-8.

Ridgway, et al., Protein Eng. Jul. 1996; 9(7):617-21.

Riechelmann, et al., Cancer Immunol Immunother. Sep. 2007; 56(9):1397-406. Epub Feb. 2, 2007.

Rispens, et al., J Am Chem Soc. Jul. 6, 2011; 133(26):10302-11.

Rothe, et al., N Biotechnol. Sep. 2011; 28(5):502-10. doi: 10. 1016/j. nbt. 2011.03.019. Epub Apr. 5, 2011.

Sampei, et al., MAbs. 2015; 7(1):120-8. doi: 10.4161/19420862. 2015.989028.

Schlereth, et al., Cancer Immunol Immunother. May 2006; 55(5):503-14. Epub Jul. 20, 2005.

Sebastian, et al., Cancer Immunol Immunather. Oct. 2007; 56(10):1637-44. Epub Apr. 5, 2007.

Seimetz, et al., Cancer Treat Rev. Oct. 2010; 36(6):458-67. dai: 10. 10161J. ctrv. 2010.03.001. Epub Mar. 27, 2010.

Sequence Alignments and modification scheme filed during oral proceedings, Jul. 25, 2018, issued by European Patent Office for Opposition in EP2006381.

Staerz, et al., Nature. Apr. 1985; 18-24:314(6012):628-31.

Staerz, et al., Prac Natl Acad Sci USA. Mar. 1986; 83(5):1453-7.

Unkeless, et al., Annu Rev Immunol. 1988; 6:251-81.

Van Den Abbeele, et al., J Nucl Med. Jan. 1994; 32(1):116-22.

Wang, et al., J Biochem. Apr. 2004; 135(4):555-65.

Wozniak-Knopp, et al., Protein Eng Des Sel. Apr. 2010; 23(4):289-97. doi: 10. 1093/protein/gzq005. Epub Feb. 11, 2010.

Zeidler, et al., J Immunol. Aug. 1, 1999; 163(3):1246-52.

Zeidler, et al., Br J Cancer Jul. 2000; 83(2):261-6.

Adams, C.W., et al., "Humanization of a Recombinant Monoclonal Antibody to Produce a Therapeutic HER Dimerization Inhibitor, Pertuzumab," Cancer Immunology, Immunotherapy, 55(6):717-727 (2006).

Annex 1, submitted by the Patentee during examination proceedings on Sep. 18, 2015 (cited in oppositions filed against European Patent No. 2647707 on May 31, 2019 and Jun. 12, 2019).

Adlersberg, J.B., "The Immunoglobulin Hinge (Interdomain) Region," Research in Clinic and Laboratory, 6(3):191-205 (1976).

Algonomics—TripoleR applications [Online], Retrieved from the Internet on Feb. 29, 2012: http://www.algonomics.com/proteinengineering/tripole_applications.php, 2 pages, available online on Feb. 21, 2009.

Almagro, J.C. and Fransson, J., "Humanization of Antibodies," Frontiers in BioScience, 13:1619-1633 (2008).

Armour, K.L., et al., "Recombinant Human IgG Molecules Lacking Fcgamma Receptor I Binding and Monocyte Triggering Activities," European Journal of Immunology, 29(8):2613-2624 (1999).

Arndt, K.M., et al., "Factors Influencing the Dimer to Monomer Transition of an Antibody Single-chain Fv Fragment," Biochemistry, 37(37)12918-12926 (1998).

Asano, R., et al., "Highly Effective Recombinant Format of a Humanized IgG-like Bispecific Antibody for Cancer Immunotherapy With Retargeting of Lymphocytes to Tumor Cells," The Journal of Biological Chemistry, 282(38):27659-27665 (2007).

Aslan, F.M., et al., "Engineering a Novel, Stable Dimeric Streptavidin With Lower Isoelectric Point," Journal of Biotechnology, 128(2):213-225 (2006).

Atwell, S., et al., "Stable Heterodimers From Remodeling the Domain Interface of a Homodimer Using a Phage Display Library," Journal of Molecular Biology, 270(1):26-35 (1997).

Baerga-Ortiz, O.A., et al., "Two Different Proteins That Compete for Binding to Thrombin Have Opposite Kinetic and Thermodynamic Profiles," Protein Science: a Publication of the Protein Society, 13(1):166-176 (2004).

(56) References Cited

OTHER PUBLICATIONS

Baeuerle, P.A and Reinhardt, C., "Bispecific T-cell Engaging Antibodies for Cancer Therapy," Cancer Research, 69(12):4941-4944 (2009).
Baeuerle, P. A., et al., "BiTE: Teaching antibodies to engage T-cells for cancer therapy," Curr Opin Mol Ther., 11(1):22-30 (2009).
Bargou, R., et al., "Tumor Regression in Cancer Patients by Very Low Doses of a T Cell-engaging Antibody," Science, 321(5891):974-977 (2008).
Barrabes, S., et al., "Effect of Sialic Acid Content on Glycoprotein Pi Analyzed by Two-Dimensional Electrophoresis," Electrophoresis, 31(17):2903-2912 (2010).
Bartelds, G.M., et al., "Clinical Response to Adalimumab: Relationship to Anti-Adalimumab Antibodies and Serum Adalimumab Concentrations in Rheumatoid Arthritis," Annals of the Rheumatic Diseases, 66(7):921-926 (2007).
Batra, S.K., et al., "Pharmacokinetics and Biodistribution of Genetically Engineered Antibodies," Current Opinion in Biotechnology, 13(6):603-608 (2002).
Beckman, R.A., et al., "Antibody Constructs in Cancer Therapy: Protein Engineering Strategies to Improve Exposure in Solid Tumors," Cancer, 109(2):170-179 (2007).
Bender, N.K., et al., "Immunogenicity, Efficacy and Adverse Events of Adalimumab in RA Patients," Rheumatology International, 27(3):269-274 (2007).
Bi, Y., et al., "Treatment of Hepatocellular Carcinoma With a Gpc3-targeted Bispecific T Cell Engager," Oncotarget, 8(32):52866-52876 (2017).
Binz, H.K., et al., "Engineering Novel Binding Proteins From Nonimmunoglobulin Domains," Nature Biotechnology, 23(10):1257-1268 (2005).
Bokemeyer, C., "Catumaxomab—trifunctional Anti-EpCAM Antibody Used to Treat Malignant Ascites," Expert Opinion on Biological Therapy, 10(8):1259-1269 (2010).
Bolt, S., et al., "The generation of a humanized, non-mitogenic CD3 monoclonal antibody which retains in vitro immunosuppressive properties," Eur J Immunol., 23:403-411 (1993).
Bowie, J.U., et al., "Deciphering the Message in Protein Sequences: Tolerance to Amino Acid Substitutions," Science, 247(4948):1306-1310 (1990).
Brezski, R. J., et al., "The Origins, Specificity, and Potential Biological Relevance of Human Anti-IgG Hinge Autoantibodies," The Scientific World Journal, 11:1153-1167 (2011).
Brischwein, K., et al., "MT110: A novel bispecific single-chain antibody construct with high efficacy in eradicating established tumors," Mol Immunol., 43:1129-1143 (2006).
Brown, M., et al., "Tolerance of Single, but Not Multiple, Amino Acid Replacements in Antibody VH CDR 2: a Means of Minimizing B Cell Wastage From Somatic Hypermutation?," Journal of Immunology, 156(9):3285-3291 (1996).
Bugelski, P. J., et al., "Monoclonal antibody-induced cytokine-release syndrome," Expert Rev Clin Immunol., 5(5):499-521 (2009).
Carpenter, P.A., et al., "Non-Fc Receptor-binding Humanized Anti-CD3 Antibodies Induce Apoptosis of Activated Human T Cells," Journal of Immunology, 165(11):6205-6213 (2000).
Carter, P., "Bispecific Human IgG by Design," Journal of Immunological Methods, 248(1-2):7-15 (2001).
Carter, P. J., "Potent antibody therapeutics by design," Nat Rev Immunol., 6:343-357 (2006).
Cespedes, M. V., et al., "Mouse Models in Oncogenesis and Cancer Therapy," Clinical & Translational Oncology, 8(5):318-329 (2006).
Chandramohan, V., et al., "Antibody, T-cell and Dendritic Cell Immunotherapy for Malignant Brain Tumors," Future Oncology, 9(7):977-990 (2013).
Chatellier, J., et al., "Functional Mapping of Conserved Residues Located at the VL and VH Domain Interface of a Fab," Journal of Molecular Biology, 264(1):1-6 (1996).

Chau, L.A., et al., "HuM291(Nuvion), a Humanized Fc Receptor-Nonbinding Antibody Against CD3, Anergizes Peripheral Blood T Cells as Partial Agonist of the T Cell Receptor," Transplantation, 71(7):941-950 (2001).
Chen, C., et al., "Defective Secretion of an Immunoglobulin Caused by Mutations in the Heavy Chain Complementarity Determining Region 2," The Journal of Experimental Medicine, 180(2):577-586 (1994).
Chen, C., et al., "Generation and Analysis of Random Point Mutations in an Antibody CDR2 Sequence: Many Mutated Antibodies Lose Their Ability to Bind Antigen," The Journal of Experimental Medicine, 176(3):855-866 (1992).
Chen, Y., et al., "Selection and Analysis of an Optimized Anti-VEGF Antibody: Crystal Structure of an Affinity-Matured Fab in Complex With Antigen," Journal of Molecular Biology 293(4):865-881 (1999).
Chernajovsky, Y. and Nissim, A., "Historical development of monoclonal antibody therapeutics," Handbook of Experimental Pharmacology, (181):3-18 (2008).
Chirino, A.J., et al., "Minimizing the Immunogenicity of Protein Therapeutics," Drug Discovery Today, 9(2):82-90 (2004).
Choi, H.J., et al., "Engineering of Immunoglobulin Fc Heterodimers Using Yeast Surface-Displayed Combinatorial Fc Library Screening," PloS One, 10(12):e0145349 (2015).
Chu, G.C., et al., "Accumulation of Succinimide in a Recombinant Monoclonal Antibody in Mildly Acidic Buffers Under Elevated Temperatures," Pharmaceutical Research, 24(6):1145-1156 (2007).
Claims as granted Nov. 5, 2015 for European Publication No. 2275443.
Cole, M.S., et al., "Human IgG2 Variants of Chimeric Anti-CD3 are Nonmitogenic to T Cells," Journal of Immunology, 159(7):3613-3621 (1997).
Coloma, M.J., et al., "Position Effects of Variable Region Carbohydrate on the Affinity and in Vivo Behavior of an Anti-(1--6) Dextran Antibody," Journal of Immunology, 162(4):2162-2170 (1999).
Comper, W.D., et al., "Charge Selectivity in Kidney Ultrafiltration," Kidney International, 47(5):1242-1251 (1995).
Cordoba, A.J., et al., "Non-Enzymatic Hinge Region Fragmentation of Antibodies in Solution," Journal of Chromatography B, 818(2):115-121 (2005).
Couto, J.R., et al., "Anti-BA46 Monoclonal Antibody Mc3: Humanization Using a Novel Positional Consensus and in Vivo and in Vitro Characterization," Cancer Research, 55(8):1717-1722 (1995).
Dall'Acqua, W., et al., "Contribution of Domain Interface Residues to the Stability of Antibody $C_H3$ Domain Homodimers," Biochem., 37:9266-9273 (1998).
Dall'Acqua, W.F., et al., "Antibody Humanization by Framework Shuffling," Methods, 36(1):43-60 (2005).
Dall'Acqua, W.F., et al., "Increasing the Affinity of a Human IgG1 for the Neonatal Fc Receptor: Biological Consequences," Journal of Immunology, 169(9):5171-5180 (2002).
Dall'Acqua, W.F., et al., "Modulation of the Effector Functions of a Human IgG1 Through Engineering of Its Hinge Region," Journal of Immunology, 177(2):1129-1138 (2006).
Dall'Acqua, W.F., et al., "Properties of Human IgG1s Engineered for Enhanced Binding to the Neonatal Fc Receptor (FcRn)," The Journal of Biological Chemistry, 281(33):23514-23524 (2006).
Damschroder, M.M., et al., "Framework Shuffling of Antibodies to Reduce Immunogenicity and Manipulate Functional and Biophysical Properties," Molecular Immunology, 44(11):3049-3060 (2007).
Davies, J., and Riechmann, L.., "Antibody VH Domains as Small Recognition Units," Bio/Technology (Nature Publishing Company), 13(5):475-479 (1995).
De Groot, A.S., et al., "De-Immunization of Therapeutic Proteins by T-cell Epitope Modification," Developments in Biologicals, 122:171-194 (2005).
Decision of the Opposition Division for EP Application No. EP2275443, Munich, Germany, dated Apr. 26, 2018, 1 page.
Declaration of Christian Beil submitted by the opponent in Opposition of EP3050963, submitted Jun. 18, 2020.
Declaration of Mr. Taichi Kuramochi, co-inventor of EP2202245 (submitted by the Patentee during EPO opposition procedure for EP2202245 on May 23, 2019).

(56) References Cited

OTHER PUBLICATIONS

Deen, W.M., et al., "Structural Determinants of Glomerular Permeability," American Journal of Physiology, Renal Physiology, 281(4):F579-F596 (2001).
Del Rio, G., et al, "An Engineered Penicillin Acylase With Altered Surface Charge is More Stable in Alkaline PH," Annals of the New York Academy of Sciences, 799:61-64 (1996).
Dennis, C., "Cancer: Off by a Whisker," Nature, 442(7104):739-741 (2006).
Diaz, R., et al., "Effects of engineering charged amino acids in the $C_H3$ domains on antibody heavy chain dimerization," Philippine Science Letters, 4(1):48-55 (2011).
Dillon, T,M., et al., "Structural and Functional Characterization of Disulfide Isoforms of the Human IgG2 Subclass," The Journal of Biological Chemistry, 283(23):16206-16215 (2008).
English translation of priority Japanese Application No. 2010-266760, filed Nov. 30, 2010, cited by Opponent 3 in opposition case EP2647707 on Mar. 26, 2020 (foreign counterpart case for related U.S. Appl. No. 13/990,088).
EP 1870459 English language translation of priority document Japanese patent application 2005101105, for European Patent Application No. EP1870459A1, submitted by opponents in opposition for EP2006381, filed Nov. 1, 2016.
EP 1870459 English language translation of priority document Japanese patent application 2005378266, for European Patent Application No. EP1870459A1, submitted by opponents in opposition for EP2006381, filed Nov. 1, 2016.
EPO Register Extract EP1915397 (document submitted in opposition case and posted by EPO on Feb. 2, 2018).
EPO Opposition Preliminary Decision dated May 13, 2020 in Opposition of EP2647707, 23 pages.
European Examination Report for EP Application No. EP18192844.1, Munich, Germany, dated Dec. 5, 2019, 6 pages, cited by Opponent 3 in opposition case EP2647707 on Mar. 26, 2020 (foreign counterpart case for related U.S. Appl. No. 13/990,088).
Ewert, S., et al., "Stability Improvement of Antibodies for Extracellular and Intracellular Applications: CDR Grafting to Stable Frameworks and Structure-based Framework Engineering," Methods, 34(2):184-199 (2004).
Feng, M. and Ho, M., "Glypican-3 antibodies: a new therapeutic target for liver cancer," FEBS Lett., 588(2):377-382 (2014).
Feucht, J., et al., "T-cell Responses Against Cd19+ Pediatric Acute Lymphoblastic Leukemia Mediated by Bispecific T-cell Engager (Bite) Are Regulated Contrarily by Pd-I1 and Cd80/cd86 on Leukemic Blasts," Oncotarget, 7(47):76902-76919 (2016).
Filmus, J., et al.,"Glypicans," Genome Biology, 9(5):224 (2008).
Final Office Action dated Nov. 4, 2020 in U.S. Appl. No. 15/776,587, Tsunenari, et al., filed May 16, 2018.
Fischer, N. and Léger, O., "Bispecific Antibodies: Molecules That Enable Novel Therapeutic Strategies," Pathobiology: Journal of Immunopathology, Molecular and Cellular Biology, 74(1):3-14 (2007).
Fujii., "Antibody Affinity Maturation by Random Mutagenesis," Methods in Molecular Biology, 248:345-359 (2004).
Fujimori, K., et al., "A Modeling Analysis of Monoclonal Antibody Percolation Through Tumors: a Binding-Site Barrier," Journal of Nuclear Medicine, 31(7):1191-1198 (1990).
Gerstner, R.B., et al., "Sequence Plasticity in the Antigen-binding Site of a Therapeutic Anti-HER2 Antibody," Journal of Molecular Biology, 321(5):851-862 (2002).
Gessner, J.E., et al., "The IgG Fc Receptor Family," Annals of Hematology, 76(6):231-248 (1998).
Ghetie, V. and Ward, E.S., "Fcrn: the Mhc Class I-related Receptor That is More Than an IgG Transporter," Immunology Today, 18(12):592-598 (1997).
Ghetie, V., et al., "Increasing the Serum Persistence of an IgG Fragment by Random Mutagenesis," Nature Biotechnology, 15(7):637-640 (1997).

Ghetie, V., et al., "Multiple Roles for the Major Histocompatibility Complex Class I-Related Receptor FcRn," Annual Review of Immunology, 18:739-766 (2000).
Gobburu, J.V., et al., "Pharmacokinetics/dynamics of 5c8, a Monoclonal Antibody to Cd154 (Cd40 Ligand) Suppression of an Immune Response in Monkeys," The Journal of Pharmacology and Experimental Therapeutics, 286(2):925-930 (1998).
Golay, J. and Introna, M., "Mechanism of Action of Therapeutic Monoclonal Antibodies: Promises and Pitfalls of in Vitro and in Vivo Assays," Archives of Biochemistry and Biophysics, 526(2):146-153 (2012).
Goode, N.P., et al., "The Glomerular Basement Membrane Charge-selectivity Barrier: an Oversimplified Concept," Nephrology Dialysis Transplantation, 11(9):1714-1716 (1996).
Gramer, M.J., et al., "Production of Stable Bispecific IgG1 by Controlled Fab-arm Exchange: Scalability From Bench to Large-scale Manufacturing by Application of Standard Approaches," mAbs, 5(6):962-973 (2013).
Graves, S.S., et al., "Molecular Modeling and Preclinical Evaluation of the Humanized NR-LU-13 Antibody," Clinical Cancer Research, 5(4):899-908 (1999).
Griffin, L.M., et al., "Analysis of Heavy and Light Chain Sequences of Conventional Camelid Antibodies From Camelus Dromedarius and Camelus Bactrianus Species," Journal of Immunological Methods, 405:35-46 (2014).
Gunasekaran, K., et al., "Enhancing Antibody Fc Heterodimer Formation Through Electrostatic Steering Effects: Applications to Bispecific Molecules and Monovalent IgG," Journal of Biological Chemistry, 285(25):19637-19646 (2010).
Guyre, P.M., et al., "Increased Potency of Fc-Receptor-Targeted Antigens," Cancer Immunology, 45(3-4):146-148 (1997).
Hamers-Casterman, C., et al., "Naturally Occurring Antibodies Devoid of Light Chains," Nature, 363(6428):446-448 (1993).
Hammond, S. A., et al., "Selective Targeting and Potent Control of Tumor Growth Using an EphA2/CD3-Bispecific Single-Chain Antibody Construct," Cancer Res., 67(8):3927-3935 (2007).
Harada, A., "In Vitro Toxicological Support to Establish Specification Limit for Anti-CD3 Monospecific Impurity in a Bispecific T Cell Engager Drug, ERY974," Toxicology in Vitro: An International Journal Published in Association with BIBRA, 66:104841 (2020).
Hattori, K., "Introduction of ART-Ig and application to hemophilia A treatment," Chugai Seiyaku ni Okeru Dokuji no Kakushinteki Kotai Gijutsu, Information Meeting on Antibody Engineering Technologies Chugai Pharmaceutical Co., Ltd. Presentation on Dec. 18, 2012, 42-57.
He, X.Y., et al., "Humanization and Pharmacokinetics of a Monoclonal Antibody With Specificity for Both E- and P-selectin," Journal of Immunology, 160(2):1029-1035, (1998).
Helguera, G. and Penichet, M. L., "Antibody-Cytokine Fusion Proteins for the Therapy of Cancer," Methods Mol Med., 109:347-374 (2005).
Hird, V., et al., "Tumour Localisation With a Radioactively Labelled Reshaped Human Monoclonal Antibody," British Journal of Cancer, 64(5):911-914 (1991).
Hong, G., et al., "Enhanced Cellular Uptake and Transport of Polyclonal Immunoglobulin G and Fab After Their Cationization," Journal of Drug Targeting, 8(2):67-77 (2000).
Hotzel, I., et al., "A Strategy for Risk Mitigation of Antibodies With Fast Clearance," mAbs, 4(6):753-760 (2012).
Huang, C., et al., "Recombinant Immunotherapeutics: Current State and Perspectives Regarding the Feasibility and Market," Applied Microbiology and Biotechnology, 87(2):401-410 (2010).
Hugo, N., et al., "Functional aspects of co-variant surface charges in an antibody fragment," Protein Sci., 11:2697-2705 (2002).
Hwang, W.Y., et al., "Use of Human Germline Genes in a CDR Homology-based Approach to Antibody Humanization," Methods, 36(1):35-42 (2005).
Igawa, T., et al., "VH/VL Interface Engineering to Promote Selective Expression and Inhibit Conformational Isomerization of Thrombopoietin Receptor Agonist Single-chain Diabody," Protein Engineering, Design & Selection, 23(8):667-677 (2010).

(56) References Cited

OTHER PUBLICATIONS

Ishiguro, T., et al., "An anti-glypican 3/CD3 bispecific T cell-redirecting antibody for treatment of solid tumors," Sci Transl Med., 9:eaal4291 (2017).
Ito, W., et al., "The His-probe Method: Effects of Histidine Residues Introduced Into the Complementarity-Determining Regions of Antibodies on Antigen-antibody Interactions at Different Ph Values," FEBS Letters, 309(1):85-88 (1992).
Iwata, Y., et al.,"Daily Ascending Dosing in Cynomolgus Monkeys to Mitigate Cytokine Release Syndrome Induced by Ery22, Surrogate for T-cell Redirecting Bispecific Antibody Ery974 for Cancer Immunotherapy," Toxicology and Applied Pharmacology, 379:114657 (2019).
Janeway, et al. Immunobiology, 5th edition. 2001:Extract from Chapter 3.
Janeway, et al. Immunobiology, 5th edition. 2001:Extract from Chapter 4.
Johnson, G. and Wu, T.T., "Kabat Database and Its Applications: 30 Years After the First Variability Plot," Nucleic Acids Research, 28(1):214-218 (2000).
Johnson, K.A., et al., "Cation Exchange-HPLC and Mass Spectrometry Reveal C-Terminal Amidation of an IgG1 Heavy Chain," Analytical Biochemistry, 360(1):75-83 (2007).
Jones, T.D., et al., "Identification and Removal of a Promiscuous CD4+ T Cell Epitope From the C1 Domain of Factor VIII," Journal of Thrombosis and Haemostasis, 3(5):991-1000 (2005).
Jung, S., et al., "The Importance of Framework Residues H6, H7 and H10 in Antibody Heavy Chains: Experimental Evidence for a New Structural Sub classification of Antibody V(H) Domains," Journal of Molecular Biology, 309(3):701-716 (2001).
Kabat, E.A., et al., "Identical V region amino acid sequences and segments of sequences in antibodies of different specificities. Relative contributions of VH and VL genes, minigenes, and complementarity-determining regions to binding of antibody-combining sites," Journal of Immunology, 147(5):1709-1719 (1991), abstract.
Kabat, E.A., et al., "Sequence of Proteins of Immunological Interest," National Institutes of Health, 5th Edition, 690, 693 (1991).
Kashmiri, S.V., et al., "Generation, Characterization, and in Vivo Studies of Humanized Anticarcinoma Antibody CC49," Hybridoma, 14(5):461-473 (1995).
Katayose, Y., et al., "MUC1-specific Targeting Immunotherapy With Bispecific Antibodies: Inhibition of Xenografted Human Bile Duct Carcinoma Growth," Cancer Research, 56(18):4205-4212 (1996).
Khalifa, M.B., et al., "Effects on Interaction Kinetics of Mutations at the VH-VL Interface of Fabs Depend on the Structural Context," Journal of Molecular Recognition, 13(3):127-139 (2000).
Khawli, L.A., et al., "Improved Tumor Localization and Radioimaging With Chemically Modified Monoclonal Antibodies," Cancer Biotherapy & Radiopharmaceuticals, 11(3):203-215 (1996).
Kim, D.Y., et al., "Antibody Light Chain Variable Domains and Their Biophysically Improved Versions for Human Immunotherapy," mAbs, 6(1):219-235 (2014).
Kim, I., et al., "Lowering of Pi by Acylation Improves the Renal Uptake of 99m Tc-labeled Anti-Tac DsFv: Effect of Different Acylating Reagents," Nuclear Medicine and Biology, 29(8):795-801 (2002).
Kim, I.S., et al., "Chemical Modification to Reduce Renal Uptake of Disulfide-bonded Variable Region Fragment of Anti-Tac Monoclonal Antibody Labeled With 99m Tc," Bioconjugate Chemistry, 10(3):447-453 (1999).
Kim, S.J., et al., "Antibody Engineering for the Development of Therapeutic Antibodies," Molecules and Cells, 20(1):17-29 (2005).
Kipriyanov, S.M., et al., "Bispecific Tandem Diabody for Tumor Therapy With Improved Antigen Binding and Pharmacokinetics," Journal of Molecular Biology, 293(1):41-56 (1999).
Kipriyanov, S.M., et al., "Effect of Domain Order on the Activity of Bacterially Produced Bispecific Single-chain Fv Antibodies," Journal of Molecular Biology, 330(1):99-111 (2003).
Klein, C., et al., "Progress in Overcoming the Chain Association Issue in Bispecific Heterodimeric IgG Antibodies," mAbs, 4(6):653-663 (2012).
Kobayashi, H., et al., "The Pharmacokinetic Characteristics of Glycolated Humanized Anti-tac Fabs Are Determined by Their Isoelectric Points," Cancer Research, 59(2):422-430 (1999).
Kohnke, T., et al., "Increase of PD-L1 Expressing B-Precursor All Cells in a Patient Resistant to the CD19/CD3-bispecific T Cell Engager Antibody Blinatumomab," Journal of Hematology and Oncology, 8:111 (2015).
Komissarov, A.A., et al, "Site-Specific Mutagenesis of a Recombinant Anti-single-stranded DNA Fab. Role of Heavy Chain Complementarity-determining Region 3 Residues in Antigen Interaction," The Journal of Biological Chemistry, 272(43):26864-26870 (1997).
Kontermann, R.E., "Recombinant Bispecific Antibodies for Cancer Therapy," Acta Pharmacologica Sinica, 26(1):1-9 (2005).
Kontermann, R. E., "Strategies to Extend Plasma Half-Lives of Recombinant Antibodies," BioDrugs, 23(2):93-109 (2009).
Korn, T., et al., "Recombinant Bispecific Antibodies for the Targeting of Adenoviruses to CEA-expressing Tumour Cells: a Comparative Analysis of Bacterially Expressed Single-chain Diabody and Tandem ScFv," Acta Pharmacologica Sinica, 6(6):642-651 (2004).
Kufer, P., et al., "A Revival of Bispecific Antibodies," Trends in Biotechnology, 22(5):238-244 (2004).
Kumagai, et al., "Humanized Bispecific Antibodies That Recognize Lymphocytes and Cancer Cells," Drug Delivery System, 23(5):518-552, (2008) with English Translation.
Kumar, R., et al., "The Second Pdz Domain of Inad is a Type I Domain Involved in Binding to Eye Protein Kinase C. Mutational Analysis and Naturally Occurring Variants," The Journal of Biological Chemistry, 276(27):24971-24977 (2001).
Kumar, S., et al., "Molecular Cloning and Expression of the Fabs of Human Autoantibodies in *Escherichia coli*," Journal of Biological Chemistry, 275(45):35129-35136 (2000).
Kurfis, J., et al., "Role of Arg182 in the Second Extracellular Loop of Angiotensin Ii Receptor AT2 in Ligand Binding," Biochemical and Biophysical Research Communications, 263(3):816-819 (1999).
Labrijn, A.F., et al., "Controlled Fab-arm Exchange for the Generation of Stable Bispecific IgG1," Nature Protocols, 9(10):2450-2463 (2014).
Labrijn, A.F., et al., "Efficient Generation of Stable Bispecific IgG1 by Controlled Fab-arm Exchange," PNAS, 110(13):5145-5150 (2013).
Labrijn, A.F., et al., "Species-specific Determinants in the IgG CH3 Domain Enable Fab-arm Exchange by Affecting the Noncovalent CH3—CH3 Interaction Strength," Journal of Immunology, 187(6):3238-3246 (2011).
Labrijn, A.F., et al., "Therapeutic IgG4 Antibodies Engage in Fab-arm Exchange With Endogenous Human IgG4 in Vivo," Nature Biotechnology, 27(8):767-771 (2009).
Le Gall, F., et al., "Effect of Linker Sequences Between the Antibody Variable Domains on the Formation, Stability and Biological Activity of a Bispecific Tandem Diabody," Protein Engineering, Design & Selection, 17(4):357-366 (2004).
Lejeune, M., et al., "Bispecific, T-Cell-Recruiting Antibodies in B-Cell Malignancies," Frontiers in Immunology, 11:762 (2020).
Leong, S.R., et al., "Adapting Pharmacokinetic Properties of a Humanized Anti-interleukin-8 Antibody for Therapeutic Applications Using Site-specific Pegylation," Cytokine, 16(3)106-119 (2001).
Li, B., et al., "Construction and Characterization of a Humanized Anti-human Cd3 Monoclonal Antibody 12f6 With Effective Immunoregulation Functions," Immunology, 116(4):487-498 (2005).
Li, B., et al., "Framework Selection Can Influence Pharmacokinetics of a Humanized Therapeutic Antibody Through Differences in Molecule Charge," mAbs, 6(5):1255-1264 (2014).
Lin, Y.S., et al., "Preclinical Pharmacokinetics, Interspecies Scaling, and Tissue Distribution of a Humanized Monoclonal Antibody Against Vascular Endothelial Growth Factor," The Journal of Pharmacology and Experimental Therapeutics, 288(1):371-378 (1999).
Liu, H., et al., "Heterogeneity of Monoclonal Antibodies," Journal of Pharmaceutical Sciences, 97(7):2426-2447 (2008).
Liu, X.Y. and Matherly, L.H., "Functional Interactions Between Arginine-133 and Aspartate-88 in the Human Reduced Folate

(56) References Cited

OTHER PUBLICATIONS

Carrier: Evidence for a Charge-pair Association," The Biochemical Journal, 358(Pt 2):511-516 (2001).
Lobo, E.D., et al., "Antibody Pharmacokinetics and Pharmacodynamics," Journal of Pharmaceutical Sciences, 93(11):2645-2668 (2004).
Lund, J., et al., "Multiple Interactions of IgG With Its Core Oligosaccharide Can Modulate Recognition by Complement and Human Fcγ Receptor I and Influence the Synthesis of Its Oligosaccharide Chains," Journal of Immunology, 157(11):4963-4969 (1996).
Lutterbuese, R., et al., "T cell-engaging BiTE antibodies specific for EGFR potently eliminate KRAS- and BRAF-mutated colorectal cancer cells," PNAS, 107(28):12605-12610 (2010).
Lutterbuese, R., et al., "Potent tumor killing and inhibition of tumor growth by CEA/CD3-bispecific single chain antibodies that are resistant to inhibition by soluble CEA," Proc Am Assoc Cancer Res., 98:abstract 4106 (2007).
Lutterbuese, R., et al., "Conversion of Cetuximab and Trastuzumab into T cell-engaging BiTE antibodies creates novel drug candidates with superior anti-tumor activity," Proc Am Assoc Cancer Res., 99:abstract 2402 (2008).
MacCallum, R.M., et al., "Antibody-antigen Interactions: Contact Analysis and Binding Site Topography," Journal of Molecular Biology, 262(5):732-745 (1996).
Mack, M., et al., "A Small Bispecific Antibody Construct Expressed as a Functional Single-chain Molecule With High Tumor Cell Cytotoxicity," PNAS, 92(15):7021-7025 (1995).
Maini, R.N., et al., "Double-blind Randomized Controlled Clinical Trial of the Interleukin-6 Receptor Antagonist, Tocilizumab, in European Patients With Rheumatoid Arthritis Who Had an Incomplete Response to Methotrexate," Arthritis and Rheumatism, 54(9):2817-2829 (2006).
Maity, H., et al., "Equilibrium Unfolding of Dimeric and Engineered Monomeric Forms of Lambda Cro (F58w) Repressor and the Effect of Added Salts: Evidence for the Formation of Folded Monomer Induced by Sodium Perchlorate," Archives of Biochemistry and Biophysics, 434(1):93-107 (2005).
Marshall, S.A, et al., "Rational Design and Engineering of Therapeutic Proteins," Drug Discovery Today, 8(5):212-221 (2003).
Marti, D.N. and Bosshard, H.R., "Inverse Electrostatic Effect: Electrostatic Repulsion in the Unfolded State Stabilizes a Leucine Zipper," Biochemistry 43(39):12436-12447 (2004).
Martin, W.L., et al., "Crystal Structure at 2.8 a of an Fcrn/heterodimeric Fc Complex: Mechanism of Ph-dependent Binding," Molecular Cell, 7(4):867-877 (2001).
Marvin, J.S. and Lowman, H.B., "Redesigning an Antibody Fragment for Faster Association With Its Antigen," Biochemistry, 42(23):7077-7083 (2003).
Marvin, J.S. and Zhu, Z., "Recombinant Approaches to IgG-like Bispecific Antibodies," Acta Pharmacologica Sinica, 26(6):649-658 (2005).
Mcearchern, J.A., et al., "Engineered Anti-cd70 Antibody With Multiple Effector Functions Exhibits in Vitro and in Vivo Antitumor Activities," Blood, 109(3):1185-1192 (2007).
McPhee, F., et al., "Engineering Human Immunodeficiency Virus 1 Protease Heterodimers as Macromolecular Inhibitors of Viral Maturation," PNAS, 93(21):11477-11481 (1996).
Mohan, C., et al., CALBIOCHEM Buffers, "A guide for the preparation and use of buffers in biological systems," EMD Biosciences, Inc., 37 pages (CALBIOCHEM Buffers Booklet, 2003).
Molhoj, M., et al., "CD19-/CD3-bispecific Antibody of the BiTE Class Is Far Superior to Tandem Diabody With Respect to Redirected Tumor Cell Lysis," Molecular Immunology, 44(8):1935-1943 (2007).
Mueller, J.P., et al., "Humanized Porcine Vcam-specific Monoclonal Antibodies With Chimeric IgG2/04 Constant Regions Block Human Leukocyte Binding to Porcine Endothelial Cells," Molecular Immunology, 34(6):441-452 (1997).
Murata, V.M., et al., "Anti-digoxin Fab Variants Generated by Phage Display," Molecular Biotechnology, 54(2):269-277 (2013).
Nakano, K., et al., "Anti-glypican 3 Antibodies Cause Adcc Against Human Hepatocellular Carcinoma Cells," Biochemical and Biophysical Research Communications, 378(2):279-284 (2009).
Narhi, L.O., et al., "Asn to Lys Mutations at Three Sites Which Are N-glycosylated in the Mammalian Protein Decrease the Aggregation of *Escherichia coli*-derived Erythropoietin," Protein Engineering, 14(2):135-140 (2001).
Nesterova, A., et al., "Glypican-3 as a novel target for an antibody-drug conjugate," AACR Abstract No. 656, Los Angeles, CA (2007).
Nieba, L., et al., "Disrupting the Hydrophobic Patches at the Antibody Variable/constant Domain Interface: Improved in Vivo Folding and Physical Characterization of an Engineered Scfv Fragment," Protein Engineering, 10(4):435-444 (1997).
Nishimoto, N., et al., "Humanized Anti-interleukin-6 Receptor Antibody Treatment of Multicentric Castleman Disease," Blood, 106(8):2627-2632 (2005).
Nishimoto, N., et al., "Interleukin 6: From Bench to Bedside," Nature Clinical Practice. Rheumatology, 2(11):619-626 (2006).
Nohaile, M.J., et al., "Altering Dimerization Specificity by Changes in Surface Electrostatics," PNAS, 98(6):3109-3114 (2001).
O'Shea, E.K., et al., "Peptide 'velcro': Design of a Heterodimeric Coiled Coil," Current Biology, 3(10):658-667 (1993).
Office Action dated May 19, 2020, in U.S. Appl. No. 15/776,587, Tsunenari, T., et al., filed May 16, 2018, 31 pages.
Office Action dated Aug. 13, 2020 in U.S. Appl. No. 15/963,221, Nezu, J., et al., filed Apr. 26, 2018, 15 pages.
Office Action dated Nov. 28, 2016 in U.S. Appl. No. 11/910,128, filed Oct. 7, 2008, Igawa, et al.
Office Action dated Sep. 12, 2017 in U.S. Appl. No. 15/467,654, filed Mar. 23, 2017, Nezu, et al.
Onda, M., et al., "Lowering the Isoelectric Point of the Fv Portion of Recombinant Immunotoxins Leads to Decreased Nonspecific Animal Toxicity Without Affecting Antitumor Activity," Cancer Research, 61(13):5070-5077 (2001).
Ono, K., et al., "The Humanized Anti-hm1.24 Antibody Effectively Kills Multiple Myeloma Cells by Human Effector Cell-mediated Cytotoxicity," Molecular Immunology, 36(6):387-395 (1999).
Ozhegov, et al., Tolkovyi Slovar Russkogo iazyka: 2004, p. 292.
Pakula, A.A., et al., "Genetic Analysis of Protein Stability and Function," Annual Review of Genetics, 23:289-310 (1989).
Pardridge, W.M., et al., "Enhanced Cellular Uptake and in Vivo Biodistribution of a Monoclonal Antibody Following Cationization," Journal of Pharmaceutical Sciences, 84(8):943-948 (1995).
Pardridge, W.M., et al., "Enhanced Endocytosis in Cultured Human Breast Carcinoma Cells and in Vivo Biodistribution in Rats of a Humanized Monoclonal Antibody After Cationization of the Protein," The Journal of Pharmacology and Experimental Therapeutics, 286(1):548-554 (1998).
Pavlinkova, G., et al., "Charge-modified Single Chain Antibody Constructs of Monoclonal Antibody CC49: Generation, Characterization, Pharmacokinetics, and Biodistribution Analysis," Nuclear Medicine and Biology, 26(1):27-34 (1999).
Pejchal, R., et al., "A Conformational Switch in Human Immunodeficiency Virus Gp41 Revealed by the Structures of Overlapping Epitopes Recognized by Neutralizing Antibodies," Journal of Virology, 83(17):8451-8462 (2009).
Peters, S.J., et al., "Engineering an Improved IgG4 Molecule With Reduced Disulfide Bond Heterogeneity and Increased Fab Domain Thermal Stability," The Journal of Biological Chemistry, 287(29):24525-24533 (2012).
Poduslo, J.F., and Curran, G.L., "Polyamine Modification Increases the Permeability of Proteins at the Blood-nerve and Blood-brain Barriers," Journal of Neurochemistry, 66(4):1599-1609 (1996).
Pokkuluri, P.R., et al., "A Domain Flip as a Result of a Single Amino-acid Substitution," Structure, 6(8)1 067-1073 (1998).
Pons, J., et al., "Energetic Analysis of an Antigen/antibody Interface: Alanine Scanning Mutagenesis and Double Mutant Cycles on the HyHEL-10/lysozyme Interaction," Protein Science: a Publication of the Protein Society, 8(5):958-968 (1999).
Presta, L. G., "Molecular Engineering and Design of Therapeutic Antibodies," Current Opinion in Immunology, 20(4):460-470 (2008).

(56) References Cited

OTHER PUBLICATIONS

Presta, L.G., "Engineering of Therapeutic Antibodies to Minimize Immunogenicity and Optimize Function," Advanced Drug Delivery Reviews, 58(5-6):640-656 (2006).
Queen, C., et al., "A Humanized Antibody That Binds to the Interleukin 2 Receptor," PNAS, 86(24):10029-10033 (1989).
Raffen, R., et al., "Reengineering Immunoglobulin Domain Interactions by Introduction of Charged Residues," Protein Engineering, 11(4):303-309 (1998).
Raghavan, M. and Bjorkman, P. J., "Fc Receptors and Their Interactions with Immunoglobulins," Annu Rev Cell Dev Biol., 12:181-220 (1996).
Rajpal, A., et al., "A General Method for Greatly Improving the Affinity of Antibodies by Using Combinatorial Libraries," PNAS, 102(24):8466-8471 (2005).
Raposo, B.,et al., "Epitope-specific antibody response is controlled by immunoglobulin $V_H$ polymorphisms," J Exp Med., 211(3):405-411 (2014).
Raposo, B.,et al., "Epitope-specific antibody response is controlled by immunoglobulin $V_H$ polymorphisms," J Exp Med., 211(3):405-411 (2014), Supplemental Material, 4 pages.
Reddy, M.P., et al., "Elimination of Fc Receptor-Dependent Effector Functions of a Modified IgG4 Monoclonal Antibody to Human CD4," Journal of Immunology, 164:1925-1933 (2000).
Reference table: IMGT exon, EU and Kabat numbering of residues within the human IgG1 sequence: retrieved from http://www.Imgt.org/IMGTScientificChart/Numbering/Hu_IGHGnber.html on Jun. 1, 2020.
Reichert, J.M., et al., "Development Trends for Monoclonal Antibody Cancer Therapeutics," Nature Reviews. Drug Discovery, 6(5):349-356 (2007).
Reimann, K.A., et al., "A Humanized Form of a CD4-specific Monoclonal Antibody Exhibits Decreased Antigenicity and Prolonged Plasma Half-life in Rhesus Monkeys While Retaining Its Unique Biological and Antiviral Properties," AIDS Research and Human Retroviruses, 13(11):933-943 (1997).
Representative abstracts showing long-term administration of a variety of anti-cancer antibodies in the prior art, submitted in Opposition of EP2647707 on Dec. 23, 2020.
Restriction Requirement dated Jun. 30, 2017 in U.S. Appl. No. 15/467,654, Nezu et al., filed May 23, 2017.
Restriction Requirement dated Nov. 13, 2019 in U.S. Appl. No. 15/776,587, Tsunenari et al., filed May 16, 2018, 17 pages.
Restriction Requirement dated Jun. 2, 2020 in U.S. Appl. No. 15/963,221, Nezu et al., filed Apr. 26, 2018, 8 pages.
Rispens, T., et al., "Dynamics of Inter-heavy Chain Interactions in Human Immunoglobulin G (IgG) Subclasses Studied by Kinetic Fab Arm Exchange," J Biol chem., 289(9):6098-6109 (2014).
Roitt, A., et al., Extract from Chapter 6, Immunology (2000), Moscow, "Mir", pp. 110-111 and English translation of section bridging pp. 110-111.
Roitt, et al., Immunology, M., Mir., 110-111 (2000)(in Russian, with what is believed to be a published English equivalent of those pages taken from Roitt et al., "Antibody Structure and Function," Immunology, 5th edition, 80-81 (1998).
Roitt, et al., Immunology, M., Mir, 2000, pp. 110, 150, and 537-539 (with English translation).
Roopenian, D.C., et al., "FcRn: the Neonatal Fc Receptor Comes of Age," Nature reviews. Immunology, 7(9):715-725 (2007).
Rothe, A., et al., "Ribosome Display for Improved Biotherapeutic Molecules," Expert Opinion on Biological Therapy, 6(2):177-187 (2006).
Rother, R. P., et al., "Discovery and development of the complement inhibitor eculizumab for the treatment of paroxysmal nocturnal hemoglobinuria," Nat Biotechnol., 25(11):1256-1264 (2007).
Rudikoff, S., et al., "Single Amino Acid Substitution Altering Antigen-Binding Specificity," PNAS, 79(6):1979-1983 (1982).
Rudnick, S.I. and Adams, G.P., "Affinity and Avidity in Antibody-Based Tumor Targeting," Cancer Biotherapy and Radiopharmaceuticals, 24(2):155-161 (2009).

Ruf, P. and Lindhofer, H., "Induction of a Long-lasting Antitumor Immunity by a Trifunctional Bispecific Antibody," Blood, 98(8):2526-2534 (2001).
Runcie, K., et al., "Bi-Specific and Tri-Specific Antibodies—The Next Big Thing in Solid Tumor Therapeutics," Molecular Medicine, 24(1):50 (2018).
Ryman, J.T. and Meibohm, B., "Pharmacokinetics of Monoclonal Antibodies," CPT: Pharmacometrics & Systems Pharmacology, 6(9):576-588 (2017).
Salfeld, J. G., "Isotype Selection in Antibody Engineering," Nature Biotechnology, 25(12):1369-1372 (2007).
Sal-Man, N. and Shai, Y., "Arginine Mutations Within a Transmembrane Domain of Tar, an *Escherichia coli* Aspartate Receptor, Can Drive Homodimer Dissociation and Heterodimer Association in Vivo," The Biochemical Journal, 385(1):29-36 (2005).
Sampei, Z., et al., "Identification and Multidimensional Optimization of an Asymmetric Bispecific IgG Antibody Mimicking the Function of Factor VIII Cofactor Activity," PloS One, 8(2):e57479 (2013).
Sarkar, C.A., et al., "Rational Cytokine Design for Increased Lifetime and Enhanced Potency Using Ph-activated "Histidine Switching"," Nature Biotechnology, 20(9):908-913 (2002).
Sato, K., et al., "Reshaping a Human Antibody to Inhibit the Interleukin 6-dependent Tumor Cell Growth," Cancer Research, 53(4):851-856 (1993).
Saunders, K. O., "Conceptual Approaches to Modulating Antibody Effector Functions and Circulation Half-Life," Front Immunol., 10(1296):1-20 (2019).
Schaefer, W., et al., "Immunoglobulin Domain Crossover as a Generic Approach for the Production of Bispecific IgG Antibodies," PNAS, 108(27):11187-11192 (2011).
Schaeffer, R.C., et al., "The Rat Glomerular Filtration Barrier Does Not Show Negative Charge Selectivity," Microcirculation, 9(5):329-342 (2002).
Schmitz, U., et al., "Phage Display: a Molecular Tool for the Generation of Antibodies—a Review," Placenta, 21:106-112 (2000).
Schneider, M.A., et al., "In Vitro and in Vivo Properties of a Dimeric Bispecific Single-chain Antibody IgG-fusion Protein for Depletion of Ccr2+ Target Cells in Mice," European Journal of Immunology, 35(3):987-995 (2005).
Schuurman, J., et al., "Normal Human Immunoglobulin G4 is Bispecific: It Has Two Different Antigen-combining Sites," Immunology, 97(4):693-698 (1999).
Schuurman, J., et al., "The Inter-heavy Chain Disulfide Bonds of IgG4 Are in Equilibrium With Intra-chain Disulfide Bonds," Molecular Immunology, 38(1):1-8 (2001).
Segal, D. M., et al., "Bispecific Antibodies in Cancer Therapy," Current Opinion in Immunology, 11:558-562 (1999).
Sequence alignments (comparison of heavy chain constant region), submitted by Patentee to European Patent Office in Dec. 23, 2020 in Opposition for EP2647707.
Sharifi, J., et al., "Improving Monoclonal Antibody Pharmacokinetics via Chemical Modification," The Quarterly Journal of Nuclear Medicine: Official Publication of the Italian Association of Nuclear Medicine (AIMN) [and] the International Association of Radiopharmacology (IAR), 42(4):242-249 (1998).
Shields, R. L., et al., "High Resolution Mapping of the Binding Site on Human IgG1 for Fc Gamma RI, Fc Gamma RIII, Fc Gamma RIII, and FcRn and Design of IgG1 Variants With Improved Binding to the Fc Gamma R," The Journal of Biological Chemistry, 276(9):6591-6604 (2001).
Shiraiwa, H., et al., "Engineering a Bispecific Antibody With a Common Light Chain: Identification and Optimization of an Anti-CD3 Epsilon and Anti-GPC3 Bispecific Antibody, ERY974," Methods, 154:10-20 (2019).
Shirakawa, H., et al., "Glypican-3 is a useful diagnostic marker for a component of hepatocellular carcinoma in human liver cancer," Int J Oncol., 34:649-656 (2009).
Shire, S.J., et al., "Challenges in the Development of High Protein Concentration Formulations," Journal of Pharmaceutical Sciences, 93(6):1390-1402 (2004).
Singer, et al., Genes & Genomes, 1:63-64 (1998), see English translation NPL242.

(56) References Cited

OTHER PUBLICATIONS

Singer, M. and Berg, P., Genes & Genomes, 67-70 (1991).
Sinha, et al., "Electrostatics in Protein Binding and Function," Current Protein & Peptide Science, 3(6):601-614 (2002).
Smith-Gill, S. J., et al., "Contributions of Immunoglobulin Heavy and Light Chains to Antibody Specificity for Lysozyme and Two Haptens," Journal of Immunology, 139(12):4135-4144 (1987).
Song, M. K., et al., "Light Chain of Natural Antibody Plays a Dominant Role in Protein Antigen Binding," Biochemical and Biophysical Research Communications, 268(2):390-394 (2000).
Spiess, C., et al., "Bispecific Antibodies With Natural Architecture Produced by Co-culture of Bacteria Expressing Two Distinct Half-antibodies," Nature Biotechnology, 31(8):753-758 (2013).
Stancovski, I., et al., "Mechanistic Aspects of the Opposing Effects of Monoclonal Antibodies to the ERBB2 Receptor on Tumor Growth," PNAS, 88(19):8691-8695 (1991).
Strand, V., et al., "Biologic Therapies in Rheumatology: Lessons Learned, Future Directions," Nature Reviews. Drug Discovery, 6(1):75-92 (2007).
Stroehlein, M.A., et al., "Induction of Anti-tumor Immunity by Trifunctional Antibodies in Patients With Peritoneal Carcinomatosis," Journal of Experimental & Clinical Cancer Research, 28:18 (2009).
Summary of information about antibodies in Examples of patent EP2006381 (document submitted in EP opposition and posted by EPO on Apr. 13, 2018).
Suzuki, "Research and Development of Antibody Pharmaceuticals," NIBS Letter 56(4):45-51 (2010), with English translation.
Szoor, A., et al.,"T Cell-Activating Mesenchymal Stem Cells as a Biotherapeutic for HCC," Molecular Therapy—Oncolytics, 6:69-79 (2017).
Tabrizi, M.A., et al., "Elimination Mechanisms of Therapeutic Monoclonal Antibodies," Drug Discovery Today, 11(1-2):81-88 (2006).
Talmadge, J.E., et al., "Murine Models to Evaluate Novel and Conventional Therapeutic Strategies for Cancer," The American Journal of Pathology, 170(3):793-804 (2007).
Tan, P.H., et al., "Contributions of a Highly Conserved VH/VL Hydrogen Bonding Interaction to ScFv Folding Stability and Refolding Efficiency," Biophysical Journal, 75(3):1473-1482 (1998).
Tan, P.H., et al., "Engineering the Isoelectric Point of a Renal Cell Carcinoma Targeting Antibody Greatly Enhances ScFv Solubility," Immunotechnology: an International Journal of Immunological Engineering, 4(2):107-114 (1998).
Tarditi, L., et al., "Selective High-performance Liquid Chromatographic Purification of Bispecific Monoclonal Antibodies," Journal of Chromatography, 599(1-2):13-20 (1992).
Teeling, J.L., et al., "The Biological Activity of Human CD20 Monoclonal Antibodies is Linked to Unique Epitopes on CD20," Journal of Immunology, 177(1):362-371 (2006).
Teerinen, T., et al., "Structure-based Stability Engineering of the Mouse IgG1 Fab Fragment by Modifying Constant Domains," Journal of Molecular Biology, 361(4):687-697 (2006).
Ten Kate, C.I., et al., "Effect of Isoelectric Point on Biodistribution and Inflammation: Imaging With Indium-111-labelled IgG," European Journal of Nuclear Medicine, 17(6-8):305-309 (1990).
Thakur, A. and Lum, L.G, "Cancer Therapy With Bispecific Antibodies: Clinical Experience," Current Opinion in Molecular Therapeutics, 12(3):340-349 (2010).
Thomas, A. K., et al., "A Cell-Based Artificial Antigen-Presenting Cell Coated with Anti-CD3 and CD28 Antibodies Enables Rapid Expansion and Long-Term Growth of CD4 T Lymphocytes," Clin Immunol., 105(3):259-272 (2002).
Thurber, G.M., et al., "Antibody Tumor Penetration: Transport Opposed by Systemic and Antigen-mediated Clearance," Advanced Drug Delivery Reviews, 60(12)1421-1434 (2008).
Tsurushita, N., et al., "Design of Humanized Antibodies: From Anti-tac to Zenapax," Methods, 36(1):69-83 (2005).
Vaisitti, T., et al., "Cationization of Monoclonal Antibodies: Another Step Towards the "Magic Bullet"," Journal of Biological Regulators and Homeostatic Agents, 19(3-4):105-112 (2005).

Vajdos, F.F., et al., "Comprehensive Functional Maps of the Antigen-binding Site of an Anti-ErbB2 Antibody Obtained With Shotgun Scanning Mutagenesis," Journal of Molecular Biology, 320(2):415-428 (2002).
Van Der Neut Kolfschoten, M., et al., "Anti-inflammatory Activity of Human IgG4 Antibodies by Dynamic Fab Arm Exchange," Science, 317(5844):1554-1557 (2007).
Van Walle, I., et al., "Immunogenicity Screening in Protein Drug Development," Expert Opinion on Biological Therapy, 7(3):405-418 (2007).
Vargas-Madrazo, E., et al., "An Improved Model of Association for VH-VL Immunoglobulin Domains: Asymmetries Between VH and VL in the Packing of Some Interface Residues," Journal of Molecular Recognition, 16(3):113-120 (2003).
Verhoeyen, M., et al., "Re-shaped human anti-PLAP antibodies," Edited by A.A. Epenetos, Chapter 5:37-43 (1991).
Verhoeyen, M.E., et al., "Construction of a Reshaped HMFG1 Antibody and Comparison of Its Fine Specificity With That of the Parent Mouse Antibody," Immunology, 78(3):364-370 (1993).
Voskoglou-Nomikos, T., et al., "Clinical Predictive Value of the in Vitro Cell Line, Human Xenograft, and Mouse Allograft Preclinical Cancer Models," Clinical Cancer Research, 9(11):4227-4239 (2003).
Waaijer, S.J., et al., "Preclinical PET Imaging of Bispecific Antibody ERY974 Targeting CD3 and Glypican 3 Reveals That Tumor Uptake Correlates to T Cell Infiltrate," Journal for Immunotherapy of Cancer, 8(1):e000548 (2020).
Wang, N., et al., "Conserved Amino Acid Networks Involved in Antibody Variable Domain Interactions," Proteins, 76(1):99-114 (2009).
Ward, E. S., et al., "Binding Activities of a Repertoire of Single Immunoglobulin Variable Domains Secreted From *Escherichia coli*," Nature, 341(6242):544-546 (1989).
Ward, W.H., et al., "Effects of Engineering Complementary Charged Residues Into the Hydrophobic Subunit Interface of Tyrosyl-tRNA Synthetase. Appendix: Kinetic Analysis of Dimeric Enzymes That Reversibly Dissociate Into Inactive Subunits," Biochemistry, 26(13):4131-4138 (1987).
Wenig, K., et al., "Structure of the Streptococcal Endopeptidase IdeS, A Cysteine Proteinase with strict Specificity for IgG," PNAS, 101(50):17371-17376 (2004).
Wiens, G.D., et al., "Mutation of a Single Conserved Residue in VH Complementarity-determining Region 2 Results in a Severe Ig Secretion Defect," Journal of Immunology, 167(4):2179-2186 (2001).
Wiens, G.D., et al., "Somatic Mutation in VH Complementarity-determining Region 2 and Framework Region 2: Differential Effects on Antigen Binding and Ig Secretion," Journal of Immunology, 159(3):1293-1302 (1997).
Weiner, G. J., et al., "The Role of T Cell Activation in Anti-CD3 x Antitumor Bispecific Antibody Therapy," J Immunol., 152:2385-2392 (1994).
Wines, B. D., et al., "The IgG Fc Contains Distinct Fc Receptor (FcR) Binding Sites: The Leukocyte Receptors FcvRI and FcvRIIa Bind to a Region in the Fc Distinct from That Recognized by Neonatal FcR and Protein A," Journal of Immunology, 164(10):5313-5318 (2000).
Wing, M. G., et al., "Mechanism of First-Dose Cytokine-Release Syndrome by CAMPATH 1-H: Involvement of CD16 (FcγRIII) and CDIIa/CD18 (LFA-1) on NK Cells," Journal of Clinical Investigation, 98(12):2819-2826 (1996).
Wolf, E., et al., "BiTEs: Bispecific Antibody Constructs With Unique Anti-tumor Activity," Drug Discovery Today, 10(18):1237-1244 (2005).
Worn, A., et al., "Stability Engineering of Antibody Single-chain Fv Fragments," Journal of Molecular Biology, 305(5):989-1010 (2001).
Written Submissions by Opponent 1 (Alexion Pharmaceuticals, Inc.) in Opposition of EP 2006381 dated Apr. 13, 2018, 19 pages.
Written Submissions by Opponent 2 (Novo Nordisk A/S) in Opposition of EP 2006381 dated Apr. 13, 2018, 14 pages.
Written Submissions by Opponent 3 (name Unknown) in Opposition of EP 2006381 dated Apr. 13, 2018, 16 pages.
Wu, A.M., et al., "Multimerization of a Chimeric Anti-CD20 Single-chain Fv-Fc Fusion Protein is Mediated Through Variable Domain Exchange," Protein Engineering, 14(12):1025-1033 (2001).

(56) References Cited

OTHER PUBLICATIONS

Wu, H., et al., "Development of Motavizumab, an Ultra-potent Antibody for the Prevention of Respiratory Syncytial Virus Infection in the Upper and Lower Respiratory Tract," Journal of Molecular Biology, 368:652-665 (2007).
Wu, H., et al., "Humanization of a Murine Monoclonal Antibody by Simultaneous Optimization of Framework and CDR Residues," Journal of Molecular Biology 294(1):151-162 (1999).
Wu, H., et al., "Ultra-potent Antibodies Against Respiratory Syncytial Virus: Effects of Binding Kinetics and Binding Valence on Viral Neutralization," Journal of Molecular Biology, 350(1):126-144 (2005).
Xiang, J., et al., "Study of B72.3 Combining Sites by Molecular Modeling and Site-directed Mutagenesis," Protein Engineering, 13(5):339-144 (2000).
Yamasaki, Y., et al., "Pharmacokinetic Analysis of in Vivo Disposition of Succinylated Proteins Targeted to Liver Nonparenchymal Cells via Scavenger Receptors: Importance of Molecular Size and Negative Charge Density for in Vivo Recognition by Receptors," The Journal of Pharmacology and Experimental Therapeutics, 301(2):467-477 (2002).
Yang, K., et al., "Tailoring Structure-function and Pharmacokinetic Properties of Single-chain Fv Proteins by Site-specific PEGylation," Protein Engineering, 16(10):761-770 (2003).
Yang, W.P., et al., "CDR Walking Mutagenesis for the Affinity Maturation of a Potent Human Anti-HIV-1 Antibody Into the Picomolar Range," Journal of Molecular Biology, 254(3):392-403 (1995).
Yu, L., et al., "A Novel Targeted Gpc3/cd3 Bispecific Antibody for the Treatment Hepatocellular Carcinoma," Cancer Biology & Therapy, 21(7):597-603 (2020).
Yu, L., et al.,"T Cell-redirecting Bispecific Antibodies in Cancer Immunotherapy: Recent Advances," Journal of Cancer Research and Clinical Oncology, 145(4):941-956 (2019).
Zhao, X., et al., "Targeting CD37-positive lymphoid malignancies with a novel engineered small modular immunopharmaceutical," Blood, 110:2569-2577 (2007).
Zhu, Z., et al., "Remodeling Domain Interfaces to Enhance Heterodimer Formation," Protein Science, 6(4):781-788 (1997).
Zuckier, L.S., et al., "Chimeric Human-mouse IgG Antibodies With Shuffled Constant Region Exons Demonstrate That Multiple Domains Contribute to in Vivo Half-life," Cancer Research, 58(17):3905-3908 (1998).
Zwick, M.B., et al., "The Long Third Complementarity-determining Region of the Heavy Chain is Important in the Activity of the Broadly Neutralizing Anti-human Immunodeficiency Virus Type 1 Antibody 2F5," Journal of Virology, 78(6):3155-3161 (2004).
Otomo, T., et al., "Structure of the heterodimeric complex between CAD domains of CAD and ICAD," Nat Struc Biol., 7(8):658-662 (2000).
U.S. Appl. No. 14/351,654, filed Apr. 14, 2014, Kuramochi, et al.
U.S. Appl. No. 07/157,273, filed Feb. 17, 1988, Morgan, et al.
U.S. Appl. No. 07/942,245, filed Sep. 9, 1992, Pedersen, et al.
U.S. Appl. No. 988,925, filed Oct. 21, 1992, Bolt, et al.
U.S. Appl. No. 08/137,117, filed Dec. 20, 1993, Tsuchiya, et al.
U.S. Appl. No. 08/781,449, filed Jan. 10, 1997, Khawli, L. A.
U.S. Appl. No. 08/908,469, filed Aug. 6, 1997, Baca, et al.
U.S. Appl. No. 08/999,942, filed Aug. 29, 1997, Smith, et al.
U.S. Appl. No. 09/166,750, filed Nov. 5, 1998, Whitlow, M.D.
U.S. Appl. No. 09/274,163, filed Mar. 22, 1999, Stevens, et al.
U.S. Appl. No. 09/339,596, filed Jun. 24, 1999, Co, et al.
U.S. Appl. No. 09/373,403, filed Aug. 12, 1999, Arathoon, et al.
U.S. Appl. No. 09/375,924, filed Aug. 17, 1999, Gallo, et al.
U.S. Appl. No. 09/450,520, filed Nov. 29, 1999, Vasquez, et al.
U.S. Appl. No. 09/483,588, filed Jan. 14, 2000, Presta, et al.
U.S. Appl. No. 09/509,098, filed Mar. 22, 2000, Tsuchiya, M.
U.S. Appl. No. 09/647,468, filed Sep. 29, 2000, Sato, et al.
U.S. Appl. No. 09/956,206, filed Sep. 17, 2001, do Couto, et al.
U.S. Appl. No. 10/118,473, filed Apr. 5, 2002, Penichet, et al.
U.S. Appl. No. 10/364,953, filed Feb. 11, 2003, Lowman, et al.
U.S. Appl. No. 10/474,832, filed Oct. 14, 2003, Lyne, et al.
U.S. Appl. No. 10/481,524, filed Jun. 30, 2004, Aburatani, et al.
U.S. Appl. No. 10/516,133, filed Feb. 18, 2005, Saito, et al.
U.S. Appl. No. 10/542,839, filed Dec. 13, 2005, Kojima, t.
U.S. Appl. No. 10/575,193, filed Oct. 8, 2004, Hattori, et al.
U.S. Appl. No. 10/861,049, filed Jun. 4, 2004, Chan, et al.
U.S. Appl. No. 11/089,426, filed Mar. 24, 2005, Gillies, et al.
U.S. Appl. No. 11/090,981, filed Mar. 24, 2005, Lazar, et al.
U.S. Appl. No. 11/149,309, filed Jun. 9, 2005, Kasaian, et al.
U.S. Appl. No. 11/165,023, filed Jun. 24, 2005, Dall'Acqua, et al.
U.S. Appl. No. 11/226,886, filed Sep. 13, 2005, Johnson, et al.
U.S. Appl. No. 11/332,619, filed Jan. 12, 2006, Moore, et al.
U.S. Appl. No. 11/636,655, filed Dec. 11, 2006, Bolt, et al.
U.S. Appl. No. 11/536,603, filed Sep. 28, 2006, Baca, et al.
U.S. Appl. No. 11/572,634, filed Jan. 25, 2007, Allan, et al.
U.S. Appl. No. 11/585,172, filed Oct. 24, 2006, Kishimoto, et al.
U.S. Appl. No. 11/676,148, filed Feb. 16, 2007, Mezo, et al.
U.S. Appl. No. 11/728,048, filed Mar. 23, 2007, Davis, et al.
U.S. Appl. No. 11/764,001, filed Jun. 15, 2007, Lazar, et al.
U.S. Appl. No. 11/765,353, filed Jun. 19, 2007, Lazar, et al.
U.S. Appl. No. 11/793,649, filed Oct. 26, 2005, Tsuchiya, et al.
U.S. Appl. No. 12/295,075, filed Apr. 20, 2009, Igawa, et al.
U.S. Appl. No. 12/524,215, filed Jul. 23, 2009, Shitara, et al.
U.S. Appl. No. 12/581,574, filed Oct. 19, 2009, Lowman, et al.
U.S. Appl. No. 12/593,759, filed Jan. 6, 2010, Schuurman, et al.
U.S. Appl. No. 12/665,009, filed May 19, 2010, Bigler, et al.
U.S. Appl. No. 12/680,082, filed Jun. 25, 2010, Igawa, et al.
U.S. Appl. No. 12/680,112, filed Jun. 23, 2010, Igawa, et al.
U.S. Appl. No. 12/733,933, filed Sep. 26, 2008, Igawa, et al.
U.S. Appl. No. 12/768,650, filed Apr. 27, 2010, Gurney, et al.
U.S. Appl. No. 12/811,207, filed Jun. 29, 2010, Kannan, et al.
U.S. Appl. No. 12/823,838, filed Jun. 25, 2010, Davis, et al.
U.S. Appl. No. 12/896,610, filed Oct. 1, 2010, Lazar, et al.
U.S. Appl. No. 13/038,576, filed Mar. 2, 2011, Niwa, et al.
U.S. Appl. No. 13/092,708, filed Apr. 22, 2011, Scheer, et al.
U.S. Appl. No. 13/093,156, filed Apr. 25, 2011, McWhirter, et al.
U.S. Appl. No. 13/257,112, filed Nov. 22, 2011, Igawa, et al.
U.S. Appl. No. 13/518,861, filed Oct. 4, 2012, Igawa, et al.
U.S. Appl. No. 13/582,073, filed Dec. 20, 2012, Kuramochi, et al.
U.S. Appl. No. 13/595,139, filed Aug. 27, 2012, Igawa, et al.
U.S. Appl. No. 13/668,098, filed Nov. 2, 2012, Spreter von Kreudenstein, et al.
U.S. Appl. No. 13/697,683, filed Jan. 17, 2013, Ho, et al.
U.S. Appl. No. 13/990,088, filed Dec. 19, 2013, Nezu, et al., related application.
U.S. Appl. No. 14/353,962, filed Apr. 24, 2014, Cramer, et al.
U.S. Appl. No. 14/629,967, filed Feb. 24, 2015, Igawa, et al.
U.S. Appl. No. 14/818,864, filed Aug. 5, 2015, McCarthy, et al.
U.S. Appl. No. 15/310,162, filed Nov. 10, 2016, Igawa, et al.
U.S. Appl. No. 15/743,248, filed Jan. 9, 2018, Jishage, et al.
U.S. Appl. No. 15/776,541, filed May 16, 2018, Igawa, T.
U.S. Appl. No. 16/083,975, filed Sep. 11, 2018, Kinoshita, et al.
U.S. Appl. No. 16/099,341, filed Nov. 6, 2018, Teranishi, et al.
U.S. Appl. No. 16/412,701, filed May 15, 2019, Adams, et al.
U.S. Appl. No. 16/605,556, filed Oct. 16, 2019, Hoshino, et al.
U.S. Appl. No. 16/692,676, filed Nov. 22, 2019, Kuramochi, et al.
U.S. Appl. No. 16/936,575, filed Jul. 23, 2020, Teranishi, et al.
Alignment of Fc domain sequences of catumaxomab and Seq ID Nos: 23, 24, 25, and 26. cited in Opposition of EP2647707 on May 31, 2019 and Jun. 12, 2019.
An, Z., et al., "IgG2m4, an engineered antibody isotype with reduced Fc function," mAbs 1(6):572-579 (2009).
Annex 1, submitted by the patentee during examination proceedings on Sep. 18, 2015 in Opposition filed against corresponding European U.S. Pat. No. 2647707.
Aschermann, S., et al., "The other side of immunoglobulin G: suppressor of inflammation," Clinical & Experimental Immunology, 160:161-167 (2010).
Bodelon, G., et al., "Immunoglobulin domains in *Escherichia coli* and other enterobacteria: from pathogenesis to applications in antibody technologies," FEMS Microbiol Rev., 37:204-250 (2013).

(56) References Cited

OTHER PUBLICATIONS

Brennen, F. R., et al., "Safety and immunotoxicity assessment of immunomodulatory monoclonal antibodies," mAbs 2(3):233-255 (2010).
Chelius, D., et al., "Structural and functional characterization of the trifunctional antibody catumaxomab," mAbs 2(3):309-319 (2010).
Das, D. and Suresh, M. R., "Producing Bispecific and Bifunctional Antibodies," Methods in Molecular Medicine 109:329-346 (2005).
Demanet, C., et al., Treatment of murine B Cell lymphoma with bispecific monoclonal antibodies (anti-idiotype x anti-CD3), J Immunol., 147:1091-1097 (1991).
English translation of European Patent Application No. 11845786.0, filed Nov. 30, 2011, now European U.S. Pat. No. 2647707.
Graca, L., "The Immune Synapse as a Novel Target for Therapy," Progress in Inflammation Research, 59-61 (2008).
Haagen, I. A., et al., "Evaluation of Fcγ receptor mediated T-cell activation by two purified CD3 x CD19 bispecific monoclonal antibodies with hybrid Fc domains," Therapeutic Immunology 1:279-287 (1994).
Haagen, I. A., et al., "Interaction of human monocyte Fc gamma receptors with rat IgG2b. A new indicator for the Fc gamma RIIa (R-H131) polymorphism," The Journal of Immunology 154:1852-1860 (1995).
Hezareh, M., et al., "Effector Function Activities of a Panel Mutants of a Broadly Neutralizing Antibody against Human Immunodeficiency Virus Type 1," Journal of Virology 75(24):12161-12168 (2001).
Hinton, P.R., et al., "An Engineered Human IgG1 Antibody With Longer Serum Half-life," Journal of Immunology, 176(1):346-356 (2006).
Hoseini, S. S., et al., "Immunotherapy of hepatocellular carcinoma using chimeric antigen receptors and bispecific antibodies," Cancer Letters 399:44-52 (2017).
Review of InvivoGen—Immunoglobulin G (2011).
Ishiguro, T., et al., "An anti-glypican 3/CD3 bispecific T cell-redirecting antibody for treatment of solid tumors," Sci Transl Med., 9:eaal4291, 13 pages (2017).
Kasthuri, R. S., et al., "Role of Tissue Factor in Cancer," J Clin Oncol., 27(29):4834-4838 (2009).
King, D. J., "Applications and Engineering of Monoclonal Antibodies," Celltech Therapeutics, 146-147 (1998).
Lazar, G. A. and Chamberlain, A. K., "Recombinant Antibodies for Immunotherapy," Affirmed Therapeutics, Little, Melvyn, Editor, 133-134 (2009).
Lindhofer, H., et al., "Bispecific Antibodies," Kontermann, R. E., Editor, 296-298 (2011).
Link, B. K., et al., " Anti-CD3-Based Bispecific Antibody Designed for Therapy of Human B-Cell Malignancy Can Induce T-Cell Activation by Antigen-Dependent and Antigen-Independent Mechanisms," Int J Cancer, 77:251-256 (1998).
Matzku, S. and Stahel, R. A., "Antibodies in Diagnosis and Therapy: Technologies, Mechanisms and Clinical Data" Studies in Medicinal Chemistry, 3:7 (1999).
Milstein, C. and Cuello, A. C., "Hybrid hybridomas and their use in immunohistochemistry," Nature, 305:537-540 (1983).
Nelson, D. L. and Cox, M. M., "Principles of Biochemistry," Fifth Edition, Lehninger, Editor, p. 171 (2008).
Nimmerjahn, F. and Ravetch, J. V., "Fcγ receptors as regulators of immune responses," Nat Rev Immunol., 8:34-47 (2008).
Nitta, T., et al., "Bispecific F(ab')$_2$ monomer prepared with anti-CD3 and anti-tumor monoclonal antibodies is most potent in induction of cytolysis of human T cells," EurJ Immunol., 19:1437-1441 (1989).
Oganesyan, V., et al., "Structural characterization of a human Fc fragment engineered for lack of effector functions," Acta Cryst., D64:700-704 (2008).
Parren, P. W. H. I., et al., "Induction of T-cell proliferation by recombinant mouse and chimeric mouse/human anti-CD3 monoclonal antibodies," Res Immunol., 142:749-763 (1991).
Ravetch, J. V., et al., "Annu Rev Immunol., Fc Receptors," 9:457-492 (1991).
Ridgway, J. B. B., et al., "'Knobs-into-holes' engineering of antibody $C_H3$ domains for heavy chain heterodimerization," Protein Eng., 9(7):617-621 (1996).
Routledge, E. G., et al., "A humanized monovalent CD3 antibody which can activate homologous complement," Eur J Immunol., 21:2717-2725 (1991).
Restriction Requirement dated Jul. 3, 2019 in U.S. Appl. No. 15/562,186, Igawa et al., filed Feb. 26, 2018.
Salnikov, A. V., et al., "Targeting of cancer stem cell marker EpCAM by bispecific antibody EpCAMxCD3 inhibits pancreatic carcinoma," J Cell Mol Med., 13(9B):4023-4033 (2009).
Segal, D. M. and Bast, B. J. E. G., "Production of Bispecific Antibodies," Current Protocols in Immunology, 2.13.1-2.13.16 (1995).
Sequence Alignments cited in Opposition of European Patent No. 2647707, (May 31, 2019 and Jun. 12, 2019).
Strauss, G., et al., "Without Prior Stimulation, Tumor-associated Lymphocytes from Malignant Effusions Lyse Autologous Tumor Cells in the Presence of Bispecific Antibody HEA125xOKT3[1]," Clin Cancer Res., 5:171-180 (1999).
Strohl, W. R., "Optimization of Fc-mediated effector functions of monoclonal antibodies," Curr Opin Biotechnol., 20:685-691 (2009).
Van Loghem, E., et al., "Staphylococcal Protein A and Human IgG Subclasses and Allotypes," Scan J Immunol., 15:275-278 (1982).
Xu, D., et al., "In Vitro Characterization of Five Humanized OKT3 Effector Function Variant Antibodies," Cellular Immunol., 200:16-26 (2000).
U.S. Appl. No. 479,752, filed Jun. 7, 1995, related application.
U.S. Appl. No. 478,825, filed Jun. 7, 1995, related application.
U.S. Appl. No. 10/370,749, filed Feb. 20, 2003, related application.
U.S. Appl. No. 10/982,470, filed Nov. 5, 2004, related application.
U.S. Appl. No. 11/396,495, filed Mar. 31, 2006, related application.
U.S. Appl. No. 11/520,121, filed Sep. 13, 2006, related application.

* cited by examiner

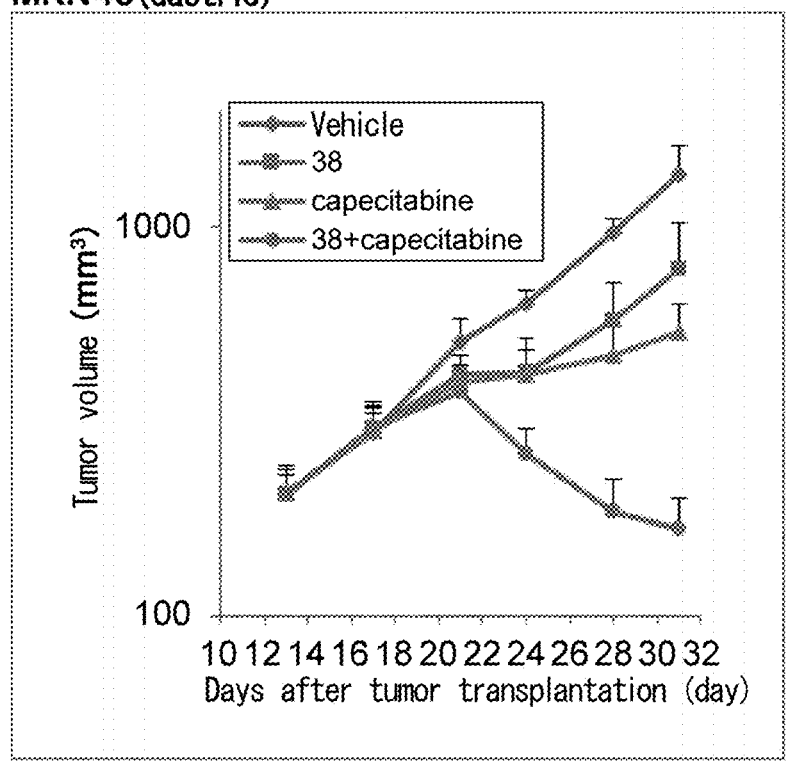
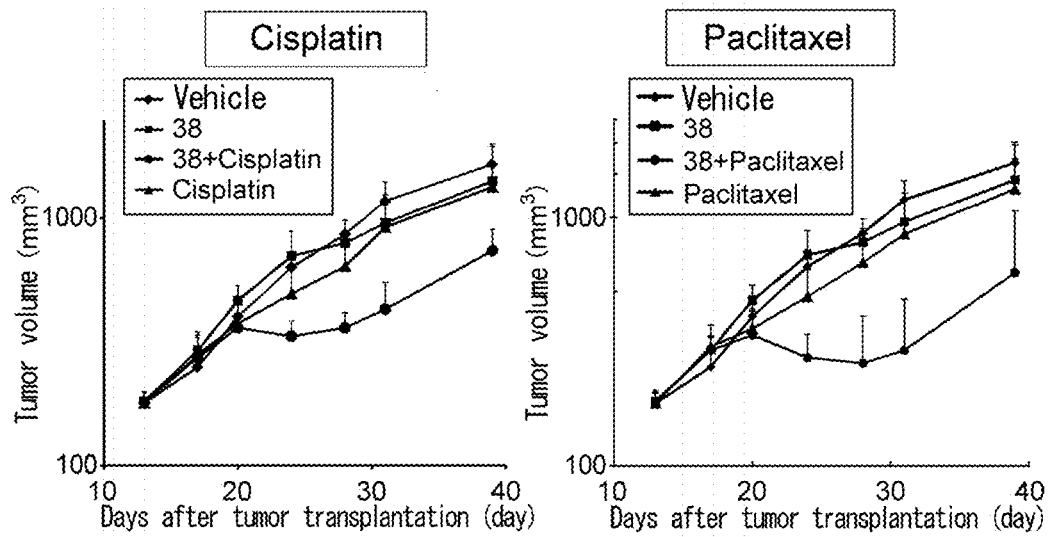
FIG. 7 a  ERY22

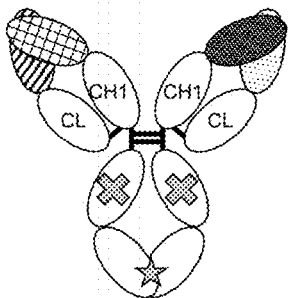

- Anti-cancer antigen (GPC3) antibody H-chain variable region
- Anti-cancer antigen (GPC3) antibody L-chain variable region
- Anti-CD3 antibody H-chain variable region
- Anti-CD3 antibody L-chain variable region
- Antibody constant region
- ✷ Silent Fc mutation
- ☆ Mutation for heteromeric Fc association b  ERY27

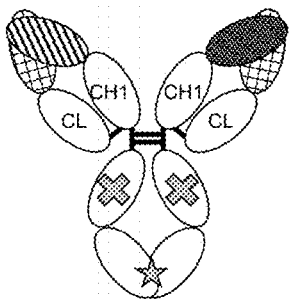

- Anti-cancer antigen (GPC3) antibody H-chain variable region
- Anti-CD3 antibody H-chain variable region
- Common L-chain variable region
- Antibody constant region
- ✷ Silent Fc mutation
- ☆ Mutation for heteromeric Fc association

FIG. 12

```
Kabat      1
EU index   1--2---------3---------4---------5---------6---------7---------8---------9---------2
           8-0-----------------------------------------------------------------------------0---0
IgG1       ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD-
IgG2       ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERK--CC
IgG3       ASTKGPSVFPLAPCSRSTSGGTAAALGCLVKDYFPEPVTVSWNSGALTSGVHTFPAVLQSSGLYSLSSVVTVPSSSLGTQTYTCNVNHKPSNTKVDKRVELKTPLG
IgG4       ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYG--

Kabat      2                                                                                                     2
EU index   2---------3---------4---------5---------6---------7---------8
           2-------8-----------------------0---------0---------0---------0
IgG1       -KTHTCPP---------------CPAPELLGGPSVFLFPPKPKDTLMISRTPEVTCVVVDVSHEDPEVKFNWYVD
IgG2       -V-R-CPP---------------CPAPPVA-GPSVFLFPPKPKDTLMISRTPEVTCVVVDVSHEDPEVQFNWYVD
IgG3       DTTHTCPRCPEPKSCDTPPPCPRCPEPKSCDTPPPCPRCPAPELLGGPSVFLFPPKPKDTLMISRTPEVTCVVVDVSHEDPEVQFKWYVD
IgG4       ---EPCFS---------------CPAPEFLGGPSVFLFPPKPKDTLMISRTPEVTCVVVDVSQEDPEVQFNWYVD Kabat      2                   3
EU index   8---------9---------0---------1---------2---------3---------4---------5---------6---------7---------8
           1---------------------------------------------------0---------0---------0---------0---------0---------0
IgG1       GVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNG
IgG2       GVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNG
IgG3       GVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSG
IgG4       GVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNG Kabat      3         4
EU index   8---------9---------0---------1---------2---------3---------4
           6---------0---------0---------0---------0---------0-------7
IgG1       QPENNYKTTPPVLDSDGSFFLYSKLTVDKSRWQQGNVFSCSVMHEALHNHYTQKSLSLSPGK  (SEQ ID NO:23)
IgG2       QPENNYKTTPPMLDSDGSFFLYSKLTVDKSRWQQGNVFSCSVMHEALHNHYTQKSLSLSPGK  (SEQ ID NO:24)
IgG3       QPENNYNTTPPMLDSDGSFFLYSKLTVDKSRWQQGNIFSCSVMHEALHNRFTQKSLSLSPGK  (SEQ ID NO:25)
IgG4       QPENNYKTTPPVLDSDGSFFLYSRLTVDKSRWQEGNVFSCSVMHEALHNHYTQKSLSLSLGK  (SEQ ID NO:26)
```

A
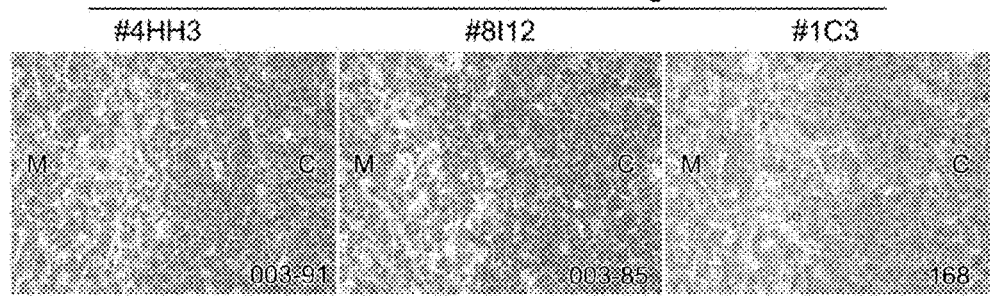
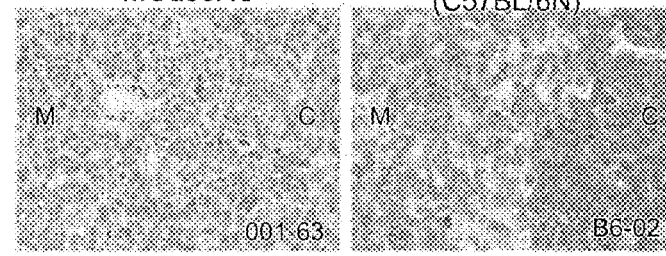
M: Medulla
C: Cortex
B
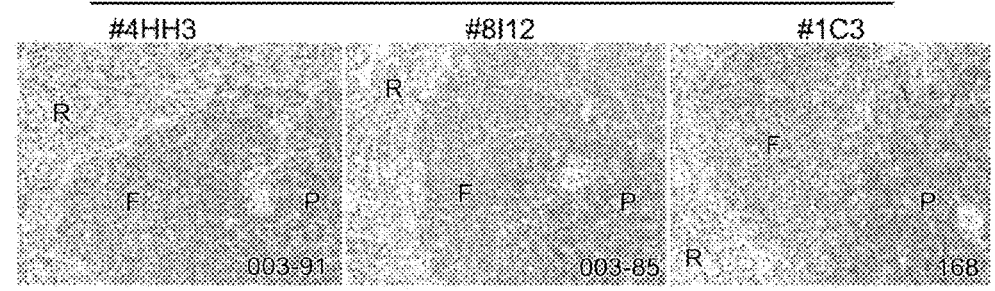
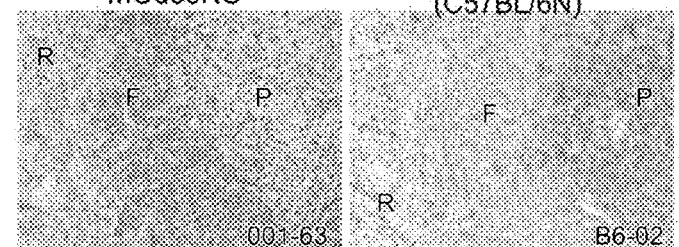
P: PALS
F: Follicle
R: Red pulp
FIG. 32

CELL INJURY INDUCING THERAPEUTIC DRUG FOR USE IN CANCER THERAPY

CROSS REFERENCE TO RELATED APPLICATIONS

This application is a U.S. National Phase of PCT Application No. PCT/JP2017/007033, filed Feb. 24, 2017, which claims priority to Japanese Patent Application No. 2016-050095, filed Mar. 14, 2016, each of which is incorporated herein by reference.

REFERENCE TO SEQUENCE LISTING SUBMITTED ELECTRONICALLY

The content of the electronically submitted sequence listing (Name: 6663_0103_Amended_Sequence_Listing.txt; Size: 616 kilobytes; and Date of Creation: Apr. 18, 2019) filed with the application is incorporated herein by reference in its entirety.

TECHNICAL FIELD

The present invention relates to multispecific antigen-binding molecules, uses thereof, and such.

BACKGROUND ART

Antibodies are drawing attention as pharmaceuticals because of their high stability in plasma and few adverse reactions (Non-patent Documents 1 and 2). Antibodies are known to induce not only an antigen-binding action, an agonistic action, and an antagonistic action, but also effector-mediated cytotoxic activities (also called effector functions) such as antibody-dependent cellular cytotoxicity (ADCC), antibody dependent cell phagocytosis (ADCP), and complement-dependent cytotoxicity (CDC), and exhibit antitumor effects against cancer cells (Non-patent Document 3). ADCC is a cytotoxicity exhibited by effector cells against antibody-bound target cancer cells via binding of the antibody Fc region to an Fc receptor present on effector cells such as NK cells and macrophages. A complement complex binds to the complement-binding site present in an antibody structure. CDC is a cytotoxicity that results from cell destruction where an influx of water and ions into cells is promoted by pore formation on the cell membrane of the antibody-bound cells by complement components present in the complex. A number of therapeutic antibodies showing excellent anti-tumor effects have been developed as pharmaceuticals for cancer treatment (Non-patent Document 4); and while existing therapeutic antibodies have shown excellent actions, the therapeutic outcome achieved by administration of these antibodies is still not satisfactory.

For an antibody to show ADCC, ADCP, and CDC, it is necessary for the antibody Fc region, the antibody receptor (FcγR) present on effector cells such as NK cells and macrophages, and various complement components to bind. In humans, isoforms of FcγRIa, FcγRIIa, FcγRIIb, FcγRIIIa, and FcγRIIIb have been reported as the FcγR protein family, and the respective allotypes have been reported as well (Non-patent Document 5). Among these isoforms, FcγRIa, FcγRIIa, and FcγRIIIa carry a domain called the Immunoreceptor Tyrosine-based Activation Motif (ITAM) in the intracellular domain, and transmit activation signals. On the other hand, only FcγRIIb carries a domain called the Immunoreceptor Tyrosine-based Inhibitory Motif (ITIM) in the intracellular domain, and transmits inhibitory signals. Every one of the FcγRs is known to transmit signals via crosslinking by immune complexes and such (Non-patent Document 6). When antibodies actually exert an effector function on cancer cells, FcγRs on the effector cell membrane form clusters at the Fc regions of several antibodies bound on the cancer cell membrane, and activation signals are transmitted by effector cells. A cytocidal effect is exerted as a result, but since FcγRs are crosslinked only in effector cells present near cancer cells this time, activation of immunity is shown to occur locally in cancer cells (Non-patent Document 7).

Naturally-occurring immunoglobulins bind to antigens at their variable regions, and bind to receptors such as FcγR, FcRn, FcαR, and FcεR, and complements at their constant regions. FcRn is one of the binding molecules that interact at the IgG Fc region, and since each of the antibody heavy chains binds one molecule of FcRn, two molecules of FcRn have been reported to bind one IgG-type antibody molecule. However, unlike FcRn and such, FcγR interacts at the antibody hinge region and CH2 domain, and only one molecule of FcγR binds to one molecule of IgG-type antibody (Non-patent Document 8). Furthermore, a common naturally-occurring IgG-type antibody recognizes and binds a single epitope via its variable region (Fab); therefore, it can bind to only one antigen. On the other hand, many types of proteins are known to be involved in cancer and inflammation, and there may be crosstalk among the proteins. For example, several inflammatory cytokines (TNF, IL1, and IL6) are known to be involved in immunological diseases (Non-patent Document 9). Furthermore, activation of other receptors is known as one of the mechanisms of cancer in acquiring drug resistance (Non-patent Document 10). In such cases, common antibodies that recognize a single epitope would be unable to inhibit multiple proteins.

Antibodies (bispecific antibodies) that bind to two or more types of antigens with one molecule are being studied as molecules that inhibit multiple targets. It is possible to confer binding activities to two different antigens (a first antigen and a second antigen) by modifying naturally-occurring IgG-type antibodies (Non-patent Document 11). Accordingly, there will not only be neutralization of two or more types of antigens by a single molecule, but also enhancement of antitumor activity due to crosslinks between cells having cytotoxic activity and cancer cells. As molecular forms of a bispecific antibody, a molecule comprising an antigen-binding site added to the N or C terminus of an antibody (DVD-Ig and scFv-IgG), a molecule having different sequences for the two Fab regions of an antibody (common L-chain bispecific antibody and hybrid hybridoma), a molecule in which one Fab region recognizes two antigens (two-in-one IgG), and a molecule having a CH3 region loop site as a new antigen-binding site (Fcab) have been reported so far (Non-patent Documents 12 and 13). Since all bispecific antibodies interact at their Fc regions with FcγR, antibody effector functions are preserved. Thus, the bispecific antibody binds to any antigen that it recognizes and at the same time binds to FcγR, and exhibits ADCC activity against cells expressing the antigen.

If all the antigens recognized by the bispecific antibody are antigens specifically expressed in cancer, the bispecific antibody exhibits cytotoxic activity to cancer cells when it binds to any of the antigens. Therefore, in comparison to a conventional antibody pharmaceutical that recognizes one antigen, a more efficient antitumor effect can be expected from such an antibody. However, in the case where any one of the antigens recognized by the bispecific antibody is expressed in normal tissues or cells expressed on immunocytes, damage on normal tissues or release of cytokines occurs due to crosslinking with FcγR (Non-patent Document 14). As a result, strong adverse reactions are induced.

A T-cell redirecting antibody that employs cytotoxicity mobilizing T cells as effector cells as the mechanism for its antitumor effect has been known from the 1980s as a bispecific antibody (Non-patent Documents 15, 16, and 17). Unlike antibodies that employ ADCC mobilizing NK cells or macrophages as effector cells as the mechanism for their antitumor effects, a T-cell redirecting antibody is an antibody against any one of the subunits constituting the T-cell receptor (TCR) complex on T cells, and is specifically a bi-specific antibody comprising an antibody that binds to the CD3 epsilon chain and an antibody that binds to an antigen on the target cancer cell. T cells come close to cancer cells via simultaneous binding of the CD3 epsilon chain and a cancer antigen by a T-cell redirecting antibody. As a result, antitumor effects against cancer cells are considered to be exerted through the cytotoxic activity possessed by T cells.

Catumaxomab, which is known as a T-cell redirecting antibody, binds at two Fabs each to a cancer antigen (Ep-CAM) and to a CD3ε (CD3 epsilon) chain expressed on T cells. Catumaxomab induces T cell-mediated cytotoxic activity by binding to the cancer antigen and the CD3ε at the same time, and induces cytotoxic activity mediated by antigen-presenting cells such as NK cells and macrophages, by binding to the cancer antigen and FcγR at the same time. By use of these two cytotoxic activities, catumaxomab exhibits a high therapeutic effect on malignant ascites by intraperitoneal administration and has thus been approved in Europe (Non-patent Document 18). In addition, there are cases where the administration of catumaxomab reportedly yields cancer cell-reactive antibodies, which clearly shows that acquired immunity is induced (Non-patent Document 19). From this result, antibodies having both T cell-mediated cytotoxic activity and the FcγR-mediated activities by cells such as NK cells or macrophages (these antibodies are particularly referred to as trifunctional antibodies) have received attention because a strong antitumor effect and induction of acquired immunity can be expected.

The trifunctional antibodies, however, bind to CD3ε and FcγR at the same time even in the absence of a cancer antigen and therefore crosslink CD3ε-expressing T cells with FcγR-expressing cells even in a cancer cell-absent environment, leading to production of various cytokines in large amounts. Such cancer antigen-independent induction of production of various cytokines restricts the current administration of the trifunctional antibodies to an intraperitoneal route (Non-patent Document 20). The trifunctional antibodies are very difficult to administer systemically due to severe cytokine storm-like adverse reactions. In fact, in the Phase I clinical trial of administering catumaxomab systemically to non-small-cell lung cancer patients, a very low dose of 5 μg/body is the maximum tolerable dose, and administration of a larger dose has been reported to cause various serious adverse reactions (Non-patent Document 21).

As such, bispecific antibodies by conventional techniques may bind to both antigens, the first antigen being the cancer antigen (EpCAM) and the second antigen being CD3ε, at the same time when they bind to FcγR; and therefore, in view of their molecular structure it is impossible to avoid adverse reactions caused by the simultaneous binding to FcγR and the second antigen CD3ε.

Meanwhile, unlike catumaxomab, BiTE has no Fcγ receptor-binding site, and therefore it does not cross-link the receptors expressed on T cells and cells such as NK cells and macrophages in a cancer antigen-independent manner. Thus, it has been demonstrated that BiTE does not cause cancer antigen-independent cytokine induction which is observed when catumaxomab is administered. However, since BiTE is a modified low-molecular-weight antibody molecule without an Fc region, the problem is that its blood half-life after administration to a patient is significantly shorter than IgG-type antibodies conventionally used as therapeutic antibodies. In fact, the blood half-life of BiTE administered in vivo has been reported to be about several hours (Non-patent Documents 22 and 23). In the clinical trials of blinatumomab, it is administered by continuous intravenous infusion using a minipump. This administration method is not only extremely inconvenient for patients but also has the potential risk of medical accidents due to device malfunction or the like. Thus, it cannot be said that such an administration method is desirable.

In recent years, use of an Fc region with reduced FcγR-binding activity has enabled maintenance of the strong antitumor activity possessed by BiTE and the excellent safety property of not inducing a cytokine storm in a cancer antigen-independent manner, and has provided novel polypeptide assemblies that have long half-lives in blood (Patent Document 1).

On the other hand, when expressing a bispecific antibody by conventional techniques, since two types of H chains and two types of L chains are expressed, ten combinations are conceivable. Among them, only one of the produced combinations has the binding specificity of interest. Therefore, to obtain the bispecific antibody of interest, the single antibody of interest must be purified from the ten types of antibodies, which is very inefficient and difficult.

A method of preferentially secreting IgGs with a heterodimeric combination of H chains, for example, a combination of an H chain against antigen A and an H chain against antigen B, by introducing amino acid substitutions into the IgG H-chain CH3 region has been reported as a method for solving this problem (Patent Documents 2, 3, 4, 5, 6, 7, and Non-patent Documents 24 and 25). A method that utilizes physical disturbance, i.e., "knob" and "hole", and a method that utilizes electric charge repulsion have been reported as such methods.

To obtain the molecule of interest with better efficiency, methods using L chains that can bind to two different antigens even though the L chains have the same amino acid sequence have been reported (Patent Documents 8 and 9). However, the antigen affinity may decrease greatly with the use of common L chains, and it is difficult to find common L chains that maintain antigen affinity.

Blinatumomab as a BiTE has been approved for acute lymphoblastic leukemia (ALL) and is also being tested in clinical trials for blood cancer such as non-Hodgkin's lymphoma (NHL) and chronic lymphocytic leukemia (CLL). Clinical trials of AMG330, which is a BiTE targeting CD33, have also been started to test it for acute myelocytic leukemia (AML). Furthermore, BiTEs against solid tumors are underdevelopment. AMG211, which is a BiTE targeting CEA, AMG110, which is a BiTE targeting EpCAM, AMG212, which is a BiTE targeting PSMA, and such are undergoing in clinical trials. However, the responsiveness of BiTEs against solid tumors remains unproved (Non-patent Document 26).

In recent years, immunotherapeutic agents, of which representatives are inhibitors targeting immune checkpoint molecules such as CTLA-4, PD-1, and PD-L1, have been demonstrated to have drug efficacy in clinical settings. However, these pharmaceutical agents are not effective in every patient, and there is demand for further enhancement of the drug efficacy. With respect to combined use of multiple immunotherapies, combined use of Nivlolumab and Ipilimumab has been found to achieve the enhanced drag efficacy against melanoma as compared to Ipilimumab alone (Non-patent Document 27).

CITATION LIST

Patent Documents

[Patent Document 1] WO2012/073985
[Patent Document 2] WO96/27011
[Patent Document 3] WO2006/106905
[Patent Document 4] WO2007/147901
[Patent Document 5] WO2009/089004
[Patent Document 6] WO2010/129304
[Patent Document 7] WO2013/065708
[Patent Document 8] WO98/050431
[Patent Document 9] WO2006/109592

Non-Patent Documents

[Non-patent Document 1] Nat. Biotechnol. (2005) 23, 1073-1078
[Non-patent Document 2] Eur J Pharm Biopharm. (2005) 59 (3), 389-396
[Non-patent Document 3] Drug Des Devel Ther (2009) 3, 7-16
[Non-patent Document 4] Clin Cancer Res. (2010) 16 (1), 11-20
[Non-patent Document 5] Immunol. Lett. (2002) 82, 57-65
[Non-patent Document 6] Nat. Rev. Immunol. (2008) 8, 34-47
[Non-patent Document 7] Ann. Rev. Immunol. (1988). 6. 251-81
[Non-patent Document 8] J. Bio. Chem., (20001) 276, 16469-16477
[Non-patent Document 9] Nat. Biotech., (2011) 28, 502-10
[Non-patent Document 10] Endocr Relat Cancer (2006) 13, 45-51
[Non-patent Document 11] MAbs. (2012) Mar. 1, 4(2)
[Non-patent Document 12] Nat. Rev. (2010) 10, 301-316
[Non-patent Document 13] Peds (2010), 23(4), 289-297
[Non-patent Document 14] J. Immunol. (1999) Aug. 1, 163(3), 1246-52
[Non-patent Document 15] Nature (1985) 314 (6012), 628-31
[Non-patent Document 16] Int J Cancer (1988) 41 (4), 609-15.
[Non-patent Document 17] Proc Nal Acad Sci USA (1986) 83 (5), 1453-7
[Non-patent Document 18] Cancer Treat Rev. (2010) Oct. 36(6), 458-67
[Non-patent Document 19] Future Oncol. (2012) Jan. 8(1), 73-85
[Non-patent Document 20] Cancer Immunol Immunother. (2007) 56(9), 1397-406
[Non-patent Document 21] Cancer Immunol Immunother. (2007) 56 (10), 1637-44
[Non-patent Document 22] Cancer Immunol Immunother. (2006) 55(5), 503-14
[Non-patent Document 23] Cancer Immunol Immunother. (2009) 58(1), 95-109
[Non-patent Document 24] Protein Engineering. (1996) vol. 9, p. 617-621
[Non-patent Document 25] Nature Biotechnology. (1998) vol. 16, p. 677-681
[Non-patent Document 26] Immunological Reviews. (2016) vol. 270, p. 193-208
[Non-patent Document 27] N Eng J Med (2015) vol. 373, p. 23-34

SUMMARY OF THE INVENTION

Problems to be Solved by the Invention

The present invention was achieved in view of the above circumstances. An objective of the present invention is to provide anticancer agents comprising as an active ingredient multispecific antigen-binding molecules that bring T cells close to the target cancer cells, and can treat cancer through the cytotoxic activity of T cells against target cancer tissues containing glypican 3-expressing cells, and are molecular forms that can be produced with high efficiency. Another objective of the present inventions is to provide combination therapies using the multispecific antigen-binding molecules and other pharmaceutical agents.

Means for Solving the Problems

The present inventors discovered an L chain common to a domain comprising a glypican 3-binding antibody variable region, and a domain comprising a T-cell receptor complex-binding antibody variable region, where the common L chain is capable of improving affinity to both antigens. This allows preparation of molecular forms that can be produced with high efficiency, and further discovery of novel multi-specific antigen-binding molecules that maintain the strong antitumor activity possessed by T-cell redirecting antibodies such as BiTE and the excellent safety property of not inducing a cytokine storm in a cancer antigen-independent manner, and also have long half-lives in blood. Furthermore, the present inventors discovered that the multispecific antigen-binding molecules comprising common L chains target glypican 3-expressing cancer cells and cause cytotoxicity. Based on this discovery, the present inventors elucidated that the multispecific antigen-binding molecules of the present invention cause injury to cancer tissues containing glypican 3-expressing cancer cells. The present inventors revealed anticancer agents that comprise as an active ingredient the multispecific antigen-binding molecule; methods for treating or preventing cancer by combined use of the multispecific antigen-binding molecule and another anticancer agent; multispecific antigen-binding molecules, anticancer agents, or pharmaceutical compositions comprising a combination of a multispecific antigen-binding molecule and an anticancer agent, each of which is used in combination therapies.

Specifically, the present invention provides the following:
[1] An anticancer agent comprising as an active ingredient a bispecific antibody of any one of (a) to (c) below that comprises an antibody variable region having glypican 3-binding activity and an antibody variable region having CD3-binding activity:

(a) a bispecific antibody in which CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody in which the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody which has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and common L chains having at least 80% identity to the amino acid sequence of SEQ ID NO: 410.

[2] An anticancer agent comprising as an active ingredient a bispecific antibody that comprises the antibody H chain of SEQ ID NO: 385 having glypican 3-binding activity, the antibody H chain of SEQ ID NO: 402 having CD3-binding activity, and the common L chains of SEQ ID NO: 410.

[3] The anticancer agent of [1] or [2], wherein the cancer is a glypican 3-positive cancer.

[4] The anticancer agent of [3], wherein the glypican 3-positive cancer is a cancer in which the number of glypican 3 antigens on cell surface per cell is 100 or more.

[5] The anticancer agent of any one of [1] to [4], wherein the cancer is any cancer selected from the group consisting of gastric cancer, head and neck cancer, esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer, anus cancer, central nervous system tumor, neuroendocrine tissue tumor, penis cancer, pleura tumor, salivary gland tumor, vulva cancer, thymoma, and childhood cancer.

[6] The anticancer agent of any one of [1] to [5], which is for treating a patient having cancer that is refractory to treatment with an immune checkpoint inhibitor.

[7] A pharmaceutical composition for use in combination with another anticancer agent, the pharmaceutical composition comprising as an active ingredient a bispecific antibody of any one of (a) to (c) below that comprises an antibody variable region having glypican 3-binding activity and an antibody variable region having CD3-binding activity:

(a) a bispecific antibody in which CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody in which the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody which has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and common L chains having at least 80% identity to the amino acid sequence of SEQ ID NO: 410.

[8] A pharmaceutical composition comprising as an active ingredient a bispecific antibody that has an antibody H chain of SEQ ID NO: 385 having glypican 3-binding activity, an antibody H chain of SEQ ID NO: 402 having CD3-binding activity, and common antibody L chains of SEQ ID NO: 410, wherein the pharmaceutical composition is for use in combination with another anticancer agent.

[9] The pharmaceutical composition of [7] or [8], wherein the bispecific antibody is administered simultaneously with said another anticancer agent.

[10] The pharmaceutical composition of [7] or [8], wherein the bispecific antibody is administered before or after administration of said another anticancer agent.

[11] The pharmaceutical composition of any one of [7] to [10], wherein said another anticancer agent is a chemotherapeutic agent, a T cell-activating agonist agent, an immune checkpoint inhibitor, or an angiogenic inhibitor.

[12] The pharmaceutical composition of [11], wherein the chemotherapeutic agent is an antimetabolite, a plant alkaloid, or a platinum compound.

[13] The pharmaceutical composition of [11], wherein the T cell-activating agonist agent is an agonist antibody against TNFRSF.

[14] The pharmaceutical composition of [11], wherein the immune checkpoint inhibitor is a PD1 antibody, a PDL1 antibody, a TIM3 antibody, or an LAG3 antibody.

[15] The pharmaceutical composition of [11], wherein the angiogenic inhibitor is a VEGFR2 antibody.

[16] An agent for inducing cytotoxicity, an agent for suppressing cell proliferation, an agent for inhibiting cell proliferation, an agent for activating immune response, an agent for treating cancer, or an agent for preventing cancer, which comprises the pharmaceutical composition of any one of [7] to [15].

[17] The anticancer agent of [1], wherein CDR1, CDR2, and CDR3 are CDR1, CDR2, and CDR3 regions based on Kabat numbering.

The following inventions are also provided:

[2-1] An anticancer agent comprising as an active ingredient a multispecific antigen-binding molecule that comprises:

(1) a domain comprising an antibody variable region having glypican 3-binding activity, (2) a domain comprising an antibody variable region having T-cell receptor complex-binding activity, and (3) a domain comprising an Fc region with reduced binding activity towards an Fcγ receptor, wherein the L chain variable regions comprised in the variable region of (1) and the variable region of (2) have a common amino acid sequence; wherein the multispecific antigen-binding molecule has a cytotoxic activity equivalent to or greater than that of the bispecific antibody GPC3_ERY22_rCE115 comprising a glypican 3-binding domain comprising SEQ ID NOs: 47 and 48, and a T-cell receptor complex-binding domain comprising SEQ ID NOs: 49 and 50.

[2-2] The anticancer agent of [2-1], wherein the cytotoxic activity is T-cell-dependent cytotoxic activity.

[2-3] The anticancer agent of [2-1] or [2-2], wherein the T-cell receptor complex-binding activity is binding activity towards a T-cell receptor.

[2-4] The anticancer agent of any one of [2-1] to [2-3], wherein the T-cell receptor complex-binding activity is binding activity towards a CD3ε chain.

[2-5] The anticancer agent of any one of [2-1] to [2-4], wherein the antibody variable region of (1) in [1] is an antibody variable region that comprises any one of the combinations of H-chain CDR1, CDR2, and CDR3 selected from (a1) to (a5) below, or an antibody variable region functionally equivalent thereto:

(a1) CDR1, CDR2, and CDR3 identical to the amino acid sequences of the CDR1, CDR2, and CDR3 regions comprised in SEQ ID NO: 40;

(a2) CDR1, CDR2, and CDR3 identical to the amino acid sequences of the CDR1, CDR2, and CDR3 regions comprised in SEQ ID NO: 197;

(a3) CDR1, CDR2, and CDR3 identical to the amino acid sequences of the CDR1, CDR2, and CDR3 regions comprised in SEQ ID NO: 206;

(a4) CDR1, CDR2, and CDR3 identical to the amino acid sequences of the CDR1, CDR2, and CDR3 regions comprised in SEQ ID NO: 211; and (a5) CDR1, CDR2, and CDR3 identical to the amino acid sequences of the CDR1, CDR2, and CDR3 regions comprised in SEQ ID NO: 215.

[2-6] The anticancer agent of any one of [2-1] to [2-4], wherein the antibody variable region of (2) in [2-1] is an antibody variable region that comprises any one of the combinations of H-chain CDR1, CDR2, and CDR3 amino acid sequences selected from (b1) to (b15) below, or an antibody variable region functionally equivalent thereto:

(b1) CDR1, CDR2, and CDR3 identical to the amino acid sequences of the CDR1, CDR2, and CDR3 regions comprised in SEQ ID NO: 52;

(b2) CDR1, CDR2, and CDR3 identical to the amino acid sequences of the CDR1, CDR2, and CDR3 regions comprised in SEQ ID NO: 103;

(b3) CDR1, CDR2, and CDR3 identical to the amino acid sequences of the CDR1, CDR2, and CDR3 regions comprised in SEQ ID NO: 122;

(b4) CDR1, CDR2, and CDR3 identical to the amino acid sequences of the CDR1, CDR2, and CDR3 regions comprised in SEQ ID NO: 128;

(b5) CDR1, CDR2, and CDR3 identical to the amino acid sequences of the CDR1, CDR2, and CDR3 regions comprised in SEQ ID NO: 129;

(b6) CDR1, CDR2, and CDR3 identical to the amino acid sequences of the CDR1, CDR2, and CDR3 regions comprised in SEQ ID NO: 132;

(b7) CDR1, CDR2, and CDR3 identical to the amino acid sequences of the CDR1, CDR2, and CDR3 regions comprised in SEQ ID NO: 142;

(b8) CDR1, CDR2, and CDR3 identical to the amino acid sequences of the CDR1, CDR2, and CDR3 regions comprised in SEQ ID NO: 144;

(b9) CDR1, CDR2, and CDR3 identical to the amino acid sequences of the CDR1, CDR2, and CDR3 regions comprised in SEQ ID NO: 164;

(b10) CDR1, CDR2, and CDR3 identical to the amino acid sequences of the CDR1, CDR2, and CDR3 regions comprised in SEQ ID NO: 168;

(b11) CDR1, CDR2, and CDR3 identical to the amino acid sequences of the CDR1, CDR2, and CDR3 regions comprised in SEQ ID NO: 421;

(b12) CDR1, CDR2, and CDR3 identical to the amino acid sequences of the CDR1, CDR2, and CDR3 regions comprised in SEQ ID NO: 424;

(b13) CDR1, CDR2, and CDR3 identical to the amino acid sequences of the CDR1, CDR2, and CDR3 regions comprised in SEQ ID NO: 426;

(b14) CDR1, CDR2, and CDR3 identical to the amino acid sequences of the CDR1, CDR2, and CDR3 regions comprised in SEQ ID NO: 429; and (b15) CDR1, CDR2, and CDR3 identical to the amino acid sequences of the CDR1, CDR2, and CDR3 regions comprised in SEQ ID NO: 430.

[2-7] The anticancer agent of any one of [2-1] to [2-4], wherein the antibody variable regions of (1) and (2) in [2-1] are antibody variable regions comprising any one of the combinations of H-chain CDR1, CDR2, and CDR3 selected from the following (c1) to (c19), or antibody variable regions functionally equivalent thereto:

(c1) CDR1, CDR2, and CDR3 comprised in the antibody variable region of (1) in [2-1] and identical to the amino acid sequences of the CDR1, CDR2, and CDR3 regions comprised in SEQ ID NO: 40; and CDR1, CDR2, and CDR3 comprised in the antibody variable region of (2) in [2-1] and identical to the amino acid sequences of the CDR1, CDR2, and CDR3 regions comprised in SEQ ID NO: 52;

(c2) CDR1, CDR2, and CDR3 comprised in the antibody variable region of (1) in [2-1] and identical to the amino acid sequences of the CDR1, CDR2, and CDR3 regions comprised in SEQ ID NO: 40; and CDR1, CDR2, and CDR3 comprised in the antibody variable region of (2) in [2-1] and identical to the amino acid sequences of the CDR1, CDR2, and CDR3 regions comprised in SEQ ID NO: 421;

(c3) CDR1, CDR2, and CDR3 comprised in the antibody variable region of (1) in [2-1] and identical to the amino acid sequences of the CDR1, CDR2, and CDR3 regions comprised in SEQ ID NO: 40; and CDR1, CDR2, and CDR3 comprised in the antibody variable region of (2) in [2-1] and identical to the amino acid sequences of the CDR1, CDR2, and CDR3 regions comprised in SEQ ID NO: 426;

(c4) CDR1, CDR2, and CDR3 comprised in the antibody variable region of (1) in [2-1] and identical to the amino acid sequences of the CDR1, CDR2, and CDR3 regions comprised in SEQ ID NO: 40; and CDR1, CDR2, and CDR3 comprised in the antibody variable region of (2) in [2-1] and identical to the amino acid sequences of the CDR1, CDR2, and CDR3 regions comprised in SEQ ID NO: 429;

(c5) CDR1, CDR2, and CDR3 comprised in the antibody variable region of (1) in [2-1] and identical to the amino acid sequences of the CDR1, CDR2, and CDR3 regions comprised in SEQ ID NO: 40; and CDR1, CDR2, and CDR3 comprised in the antibody variable region of (2) in [2-1] and identical to the amino acid sequences of the CDR1, CDR2, and CDR3 regions comprised in SEQ ID NO: 430;

(c6) CDR1, CDR2, and CDR3 comprised in the antibody variable region of (1) in [2-1] and identical to the amino acid sequences of the CDR1, CDR2, and CDR3 regions comprised in SEQ ID NO: 197; and CDR1, CDR2, and CDR3 comprised in the antibody variable region of (2) in [2-1] and identical to the amino acid sequences of the CDR1, CDR2, and CDR3 regions comprised in SEQ ID NO: 128;

(c7) CDR1, CDR2, and CDR3 comprised in the antibody variable region of (1) in [2-1] and identical to the amino acid sequences of the CDR1, CDR2, and CDR3 regions comprised in SEQ ID NO: 206; and CDR1, CDR2, and CDR3 comprised in the antibody variable region of (2) in [2-1] and identical to the amino acid sequences of the CDR1, CDR2, and CDR3 regions comprised in SEQ ID NO: 142;

(c8) CDR1, CDR2, and CDR3 comprised in the antibody variable region of (1) in [2-1] and identical to the amino acid sequences of the CDR1, CDR2, and CDR3 regions comprised in SEQ ID NO: 206; and CDR1, CDR2, and CDR3 comprised in the antibody variable region of (2) in [2-1] and identical to the amino acid sequences of the CDR1, CDR2, and CDR3 regions comprised in SEQ ID NO: 144;

(c9) CDR1, CDR2, and CDR3 comprised in the antibody variable region of (1) in [2-1] and identical to the amino acid sequences of the CDR1, CDR2, and CDR3 regions comprised in SEQ ID NO: 206; and CDR1, CDR2, and CDR3 comprised in the antibody variable region of (2) in [2-1] and identical to the amino acid sequences of the CDR1, CDR2, and CDR3 regions comprised in SEQ ID NO: 164;

(c10) CDR1, CDR2, and CDR3 comprised in the antibody variable region of (1) in [2-1] and identical to the amino acid sequences of the CDR1, CDR2, and CDR3 regions comprised in SEQ ID NO: 206; and CDR1, CDR2, and CDR3 comprised in the antibody variable region of (2) in [2-1] and identical to the amino acid sequences of the CDR1, CDR2, and CDR3 regions comprised in SEQ ID NO: 168;

(c11) CDR1, CDR2, and CDR3 comprised in the antibody variable region of (1) in [2-1] and identical to the amino acid sequences of the CDR1, CDR2, and CDR3 regions comprised in SEQ ID NO: 211; and CDR1, CDR2, and CDR3 comprised in the antibody variable region of (2) in [2-1] and identical to the amino acid sequences of the CDR1, CDR2, and CDR3 regions comprised in SEQ ID NO: 142;

(c12) CDR1, CDR2, and CDR3 comprised in the antibody variable region of (1) in [2-1] and identical to the amino acid sequences of the CDR1, CDR2, and CDR3 regions comprised in SEQ ID NO: 211; and CDR1, CDR2, and CDR3 comprised in the antibody variable region of (2) in [2-1] and identical to the amino acid sequences of the CDR1, CDR2, and CDR3 regions comprised in SEQ ID NO: 144;

(c13) CDR1, CDR2, and CDR3 comprised in the antibody variable region of (1) in [2-1] and identical to the amino acid sequences of the CDR1, CDR2, and CDR3 regions comprised in SEQ ID NO: 211; and CDR1, CDR2, and CDR3 comprised in the antibody variable region of (2) in [2-1] and identical to the amino acid sequences of the CDR1, CDR2, and CDR3 regions comprised in SEQ ID NO: 164;

(c14) CDR1, CDR2, and CDR3 comprised in the antibody variable region of (1) in [2-1] and identical to the amino acid sequences of the CDR1, CDR2, and CDR3 regions comprised in SEQ ID NO: 211; and CDR1, CDR2, and CDR3 comprised in the antibody variable region of (2) in [2-1] and identical to the amino acid sequences of the CDR1, CDR2, and CDR3 regions comprised in SEQ ID NO: 168;

(c15) CDR1, CDR2, and CDR3 comprised in the antibody variable region of (1) in [2-1] and identical to the amino acid sequences of the CDR1, CDR2, and CDR3 regions comprised in SEQ ID NO: 215; and CDR1, CDR2, and CDR3 comprised in the antibody variable region of (2) in [2-1] and identical to the amino acid sequences of the CDR1, CDR2, and CDR3 regions comprised in SEQ ID NO: 103;

(c16) CDR1, CDR2, and CDR3 comprised in the antibody variable region of (1) in [2-1] and identical to the amino acid sequences of the CDR1, CDR2, and CDR3 regions comprised in SEQ ID NO: 215; and CDR1, CDR2, and CDR3 comprised in the antibody variable region of (2) in [2-1] and identical to the amino acid sequences of the CDR1, CDR2, and CDR3 regions comprised in SEQ ID NO: 122;

(c17) CDR1, CDR2, and CDR3 comprised in the antibody variable region of (1) in [2-1] and identical to the amino acid sequences of the CDR1, CDR2, and CDR3 regions comprised in SEQ ID NO: 215; and CDR1, CDR2, and CDR3 comprised in the antibody variable region of (2) in [2-1] and identical to the amino acid sequences of the CDR1, CDR2, and CDR3 regions comprised in SEQ ID NO: 129;

(c18) CDR1, CDR2, and CDR3 comprised in the antibody variable region of (1) in [2-1] and identical to the amino acid sequences of the CDR1, CDR2, and CDR3 regions comprised in SEQ ID NO: 215; and CDR1, CDR2, and CDR3 comprised in the antibody variable region of (2) in [2-1] and identical to the amino acid sequences of the CDR1, CDR2, and CDR3 regions comprised in SEQ ID NO: 132; and (c19) CDR1, CDR2, and CDR3 comprised in the antibody variable region of (1) in [2-1] and identical to the amino acid sequences of the CDR1, CDR2, and CDR3 regions comprised in SEQ ID NO: 215; and CDR1, CDR2, and CDR3 comprised in the antibody variable region of (2) in [2-1] and identical to the amino acid sequences of the CDR1, CDR2, and CDR3 regions comprised in SEQ ID NO: 424.

[2-8] The anticancer agent of any one of [2-5] to [2-7], wherein CDR1, CDR2, and CDR3 are CDR1, CDR2, and CDR3 regions based on Kabat numbering.

[2-9] The anticancer agent of any one of [2-1] to [2-4], wherein the antibody variable region of (1) in [2-1] is an antibody variable region comprising any one of the H-chain variable regions selected from (a1) to (a5) below, or an antibody variable region functionally equivalent thereto:

(a1) an H-chain variable region having the amino acid sequence of SEQ ID NO: 40;

(a2) an H-chain variable region having the amino acid sequence of SEQ ID NO: 197;

(a3) an H-chain variable region having the amino acid sequence of SEQ ID NO: 206;

(a4) an H-chain variable region having the amino acid sequence of SEQ ID NO: 211; and (a5) an H-chain variable region having the amino acid sequence of SEQ ID NO: 215.

[2-10] The anticancer agent of any one of [2-1] to [2-4], wherein the antibody variable region of (2) in [2-1] is an antibody variable region comprising any one of the H-chain variable regions selected from (b1) to (b15) below, or an antibody variable region functionally equivalent thereto:

(b1) an H-chain variable region having the amino acid sequence of SEQ ID NO: 52;

(b2) an H-chain variable region having the amino acid sequence of SEQ ID NO: 103;

(b3) an H-chain variable region having the amino acid sequence of SEQ ID NO: 122;

(b4) an H-chain variable region having the amino acid sequence of SEQ ID NO: 128;

(b5) an H-chain variable region having the amino acid sequence of SEQ ID NO: 129;

(b6) an H-chain variable region having the amino acid sequence of SEQ ID NO: 132;

(b7) an H-chain variable region having the amino acid sequence of SEQ ID NO: 142;

(b8) an H-chain variable region having the amino acid sequence of SEQ ID NO: 144;

(b9) an H-chain variable region having the amino acid sequence of SEQ ID NO: 164;

(b10) an H-chain variable region having the amino acid sequence of SEQ ID NO: 168;

(b11) an H-chain variable region having the amino acid sequence of SEQ ID NO: 421;

(b12) an H-chain variable region having the amino acid sequence of SEQ ID NO: 424;

(b13) an H-chain variable region having the amino acid sequence of SEQ ID NO: 426;

(b14) an H-chain variable region having the amino acid sequence of SEQ ID NO: 429; and (b15) an H-chain variable region having the amino acid sequence of SEQ ID NO: 430.

[2-11] The anticancer agent of any one of [2-1] to [2-4], wherein the antibody variable regions of (1) and (2) in [2-1] are antibody variable regions comprising any one of the combinations of H-chain variable regions selected from (c1) to (c19) below, or antibody variable regions functionally equivalent thereto:

(c1) an H-chain variable region comprised in the antibody variable region of (1) in [2-1] which has the amino acid sequence of SEQ ID NO: 40; and an H-chain variable region comprised in the antibody variable region of (2) in [2-1] which has the amino acid sequence of SEQ ID NO: 52;

(c2) an H-chain variable region comprised in the antibody variable region of (1) in [2-1] which has the amino acid sequence of SEQ ID NO: 40; and an H-chain variable region comprised in the antibody variable region of (2) in [2-1] which has the amino acid sequence of SEQ ID NO: 421;

(c3) an H-chain variable region comprised in the antibody variable region of (1) in [2-1] which has the amino acid sequence of SEQ ID NO: 40; and an H-chain variable region comprised in the antibody variable region of (2) in [2-1] which has the amino acid sequence of SEQ ID NO: 426;

(c4) an H-chain variable region comprised in the antibody variable region of (1) in [2-1] which has the amino acid sequence of SEQ ID NO: 40; and an H-chain variable region comprised in the antibody variable region of (2) in [2-1] which has the amino acid sequence of SEQ ID NO: 429;

(c5) an H-chain variable region comprised in the antibody variable region of (1) in [2-1] which has the amino acid sequence of SEQ ID NO: 40; and an H-chain variable region comprised in the antibody variable region of (2) in [2-1] which has the amino acid sequence of SEQ ID NO: 430;

(c6) an H-chain variable region comprised in the antibody variable region of (1) in [2-1] which has the amino acid sequence of SEQ ID NO: 197; and an H-chain variable region comprised in the antibody variable region of (2) in [2-1] which has the amino acid sequence of SEQ ID NO: 128;

(c7) an H-chain variable region comprised in the antibody variable region of (1) in [2-1] which has the amino acid sequence of SEQ ID NO: 206; and an H-chain variable region comprised in the antibody variable region of (2) in [2-1] which has the amino acid sequence of SEQ ID NO: 142;

(c8) an H-chain variable region comprised in the antibody variable region of (1) in [2-1] which has the amino acid sequence of SEQ ID NO: 206; and an H-chain variable region comprised in the antibody variable region of (2) in [2-1] which has the amino acid sequence of SEQ ID NO: 144;

(c9) an H-chain variable region comprised in the antibody variable region of (1) in [2-1] which has the amino acid sequence of SEQ ID NO: 206; and an H-chain variable region comprised in the antibody variable region of (2) in [2-1] which has the amino acid sequence of SEQ ID NO: 164;

(c10) an H-chain variable region comprised in the antibody variable region of (1) in [2-1] which has the amino acid sequence of SEQ ID NO: 206; and an H-chain variable region comprised in the antibody variable region of (2) in [2-1] which has the amino acid sequence of SEQ ID NO: 168;

(c11) an H-chain variable region comprised in the antibody variable region of (1) in [2-1] which has the amino acid sequence of SEQ ID NO: 211; and an H-chain variable region comprised in the antibody variable region of (2) in [2-1] which has the amino acid sequence of SEQ ID NO: 142;

(c12) an H-chain variable region comprised in the antibody variable region of (1) in [2-1] which has the amino acid sequence of SEQ ID NO: 211; and an H-chain variable region comprised in the antibody variable region of (2) in [2-1] which has the amino acid sequence of SEQ ID NO: 144;

(c13) an H-chain variable region comprised in the antibody variable region of (1) in [2-1] which has the amino acid sequence of SEQ ID NO: 211; and an H-chain variable region comprised in the antibody variable region of (2) in [2-1] which has the amino acid sequence of SEQ ID NO: 164;

(c14) an H-chain variable region comprised in the antibody variable region of (1) in [2-1] which has the amino acid sequence of SEQ ID NO: 211; and an H-chain variable region comprised in the antibody variable region of (2) in [2-1] which has the amino acid sequence of SEQ ID NO: 168;

(c15) an H-chain variable region comprised in the antibody variable region of (1) in [2-1] which has the amino acid sequence of SEQ ID NO: 215; and an H-chain variable region comprised in the antibody variable region of (2) in [2-1] which has the amino acid sequence of SEQ ID NO: 103;

(c16) an H-chain variable region comprised in the antibody variable region of (1) in [2-1] which has the amino acid sequence of SEQ ID NO: 215; and an H-chain variable region comprised in the antibody variable region of (2) in [2-1] which has the amino acid sequence of SEQ ID NO: 122;

(c17) an H-chain variable region comprised in the antibody variable region of (1) in [2-1] which has the amino acid sequence of SEQ ID NO: 215; and an H-chain variable region comprised in the antibody variable region of (2) in [2-1] which has the amino acid sequence of SEQ ID NO: 129;

(c18) an H-chain variable region comprised in the antibody variable region of (1) in [2-1] which has the amino acid sequence of SEQ ID NO: 215; and an H-chain variable region comprised in the antibody variable region of (2) in [2-1] which has the amino acid sequence of SEQ ID NO: 132; and (c19) an H-chain variable region comprised in the antibody variable region of (1) in [2-1] which has the amino acid sequence of SEQ ID NO: 215; and an H-chain variable region comprised in the antibody variable region of (2) in [2-1] which has the amino acid sequence of SEQ ID NO: 424.

[2-12] The anticancer agent of any one of [2-1] to [2-11], wherein the common L chain of [2-1] is a common L chain comprising any one of the combinations of CDR1, CDR2, and CDR3 selected from (d1) to (d11) below, or a common L chain functionally equivalent thereto:

(d1) CDR1, CDR2, and CDR3 identical to the amino acid sequences of the CDR1, CDR2, and CDR3 regions comprised in SEQ ID NO: 53;

(d2) CDR1, CDR2, and CDR3 identical to the amino acid sequences of the CDR1, CDR2, and CDR3 regions comprised in SEQ ID NO: 223;

(d3) CDR1, CDR2, and CDR3 identical to the amino acid sequences of the CDR1, CDR2, and CDR3 regions comprised in SEQ ID NO: 299;

(d4) CDR1, CDR2, and CDR3 identical to the amino acid sequences of the CDR1, CDR2, and CDR3 regions comprised in SEQ ID NO: 301;

(d5) CDR1, CDR2, and CDR3 identical to the amino acid sequences of the CDR1, CDR2, and CDR3 regions comprised in SEQ ID NO: 302;

(d6) CDR1, CDR2, and CDR3 identical to the amino acid sequences of the CDR1, CDR2, and CDR3 regions comprised in SEQ ID NO: 304;

(d7) CDR1, CDR2, and CDR3 identical to the amino acid sequences of the CDR1, CDR2, and CDR3 regions comprised in SEQ ID NO: 306;

(d8) CDR1, CDR2, and CDR3 identical to the amino acid sequences of the CDR1, CDR2, and CDR3 regions comprised in SEQ ID NO: 307;

(d9) CDR1, CDR2, and CDR3 identical to the amino acid sequences of the CDR1, CDR2, and CDR3 regions comprised in SEQ ID NO: 309;

(d10) CDR1, CDR2, and CDR3 identical to the amino acid sequences of the CDR1, CDR2, and CDR3 regions comprised in SEQ ID NO: 310; and (d11) CDR1, CDR2, and CDR3 identical to the amino acid sequences of the CDR1, CDR2, and CDR3 regions comprised in SEQ ID NO: 319.

[2-13] The anticancer agent of any one of [2-1] to [2-11], wherein the L chain variable region of [2-1] is a variable region of any one of the L chain amino acid sequences selected from (d1) to (d11) below:

(d1) an L chain comprising the amino acid sequence of SEQ ID NO: 53;

(d2) an L chain comprising the amino acid sequence of SEQ ID NO: 223;

(d3) an L chain comprising the amino acid sequence of SEQ ID NO: 299;

(d4) an L chain comprising the amino acid sequence of SEQ ID NO: 301;

(d5) an L chain comprising the amino acid sequence of SEQ ID NO: 302;

(d6) an L chain comprising the amino acid sequence of SEQ ID NO: 304;

(d7) an L chain comprising the amino acid sequence of SEQ ID NO: 306;

(d8) an L chain comprising the amino acid sequence of SEQ ID NO: 307;

(d9) an L chain comprising the amino acid sequence of SEQ ID NO: 309;

(d10) an L chain comprising the amino acid sequence of SEQ ID NO: 310; and (d11) an L chain comprising the amino acid sequence of SEQ ID NO: 319.

[2-14] The anticancer agent of any one of [2-1] to [2-4], wherein the antibody variable regions of (1) and (2) of [2-1] and the common L chain variable region are antibody variable regions comprising any one of the combinations of H-chain CDR1, CDR2, and CDR3 and L-chain CDR1, CDR2, and CDR3 selected from (e1) to (e25) below, or antibody variable regions functionally equivalent thereto:

(e1) CDR1, CDR2, and CDR3 comprised in the antibody variable region of (1) in [2-1] and identical to the amino acid sequences of the CDR1, CDR2, and CDR3 regions comprised in SEQ ID NO: 197; CDR1, CDR2, and CDR3 comprised in the antibody variable region of (2) in [2-1] and identical to the amino acid sequences of the CDR1, CDR2, and CDR3 regions comprised in SEQ ID NO: 128; and CDR1, CDR2, and CDR3 comprised in the antibody variable region of the common L chain and identical to the amino acid sequences of the CDR1, CDR2, and CDR3 regions comprised in SEQ ID NO: 53;

(e2) CDR1, CDR2, and CDR3 comprised in the antibody variable region of (1) in [2-1] and identical to the amino acid sequences of the CDR1, CDR2, and CDR3 regions comprised in SEQ ID NO: 197; CDR1, CDR2, and CDR3 comprised in the antibody variable region of (2) in [2-1] and identical to the amino acid sequences of the CDR1, CDR2, and CDR3 regions comprised in SEQ ID NO: 128; and CDR1, CDR2, and CDR3 comprised in the antibody variable region of the common L chain and identical to the amino acid sequences of the CDR1, CDR2, and CDR3 regions comprised in SEQ ID NO: 299;

(e3) CDR1, CDR2, and CDR3 comprised in the antibody variable region of (1) in [2-1] and identical to the amino acid sequences of the CDR1, CDR2, and CDR3 regions comprised in SEQ ID NO: 197; CDR1, CDR2, and CDR3 comprised in the antibody variable region of (2) in [2-1] and identical to the amino acid sequences of the CDR1, CDR2, and CDR3 regions comprised in SEQ ID NO: 128; and CDR1, CDR2, and CDR3 comprised in the antibody variable region of the common L chain and identical to the amino acid sequences of the CDR1, CDR2, and CDR3 regions comprised in SEQ ID NO: 310;

(e4) CDR1, CDR2, and CDR3 comprised in the antibody variable region of (1) in [2-1] and identical to the amino acid sequences of the CDR1, CDR2, and CDR3 regions comprised in SEQ ID NO: 197; CDR1, CDR2, and CDR3 comprised in the antibody variable region of (2) in [2-1] and identical to the amino acid sequences of the CDR1, CDR2, and CDR3 regions comprised in SEQ ID NO: 128; and CDR1, CDR2, and CDR3 comprised in the antibody variable region of the common L chain and identical to the amino acid sequences of the CDR1, CDR2, and CDR3 regions comprised in SEQ ID NO: 319;

(e5) CDR1, CDR2, and CDR3 comprised in the antibody variable region of (1) in [2-1] and identical to the amino acid sequences of the CDR1, CDR2, and CDR3 regions comprised in SEQ ID NO: 206; CDR1, CDR2, and CDR3 comprised in the antibody variable region of (2) in [2-1] and identical to the amino acid sequences of the CDR1, CDR2, and CDR3 regions comprised in SEQ ID NO: 142; and CDR1, CDR2, and CDR3 comprised in the antibody variable region of the common L chain and identical to the amino acid sequences of the CDR1, CDR2, and CDR3 regions comprised in SEQ ID NO: 223;

(e6) CDR1, CDR2, and CDR3 comprised in the antibody variable region of (1) in [2-1] and identical to the amino acid sequences of the CDR1, CDR2, and CDR3 regions comprised in SEQ ID NO: 206; CDR1, CDR2, and CDR3 comprised in the antibody variable region of (2) in [2-1] and identical to the amino acid sequences of the CDR1, CDR2, and CDR3 regions comprised in SEQ ID NO: 144; and CDR1, CDR2, and CDR3 comprised in the antibody variable region of the common L chain and identical to the amino acid sequences of the CDR1, CDR2, and CDR3 regions comprised in SEQ ID NO: 223;

(e7) CDR1, CDR2, and CDR3 comprised in the antibody variable region of (1) in [2-1] and identical to the amino acid sequences of the CDR1, CDR2, and CDR3 regions comprised in SEQ ID NO: 206; CDR1, CDR2, and CDR3 comprised in the antibody variable region of (2) in [2-1] and identical to the amino acid sequences of the CDR1, CDR2, and CDR3 regions comprised in SEQ ID NO: 164; and CDR1, CDR2, and CDR3 comprised in the antibody variable region of the common L chain and identical to the amino acid sequences of the CDR1, CDR2, and CDR3 regions comprised in SEQ ID NO: 223;

(e8) CDR1, CDR2, and CDR3 comprised in the antibody variable region of (1) in [2-1] and identical to the amino acid sequences of the CDR1, CDR2, and CDR3 regions comprised in SEQ ID NO: 206; CDR1, CDR2, and CDR3 comprised in the antibody variable region of (2) in [2-1] and identical to the amino acid sequences of the CDR1, CDR2, and CDR3 regions comprised in SEQ ID NO: 168; and CDR1, CDR2, and CDR3 comprised in the antibody variable region of the common L chain and identical to the amino acid sequences of the CDR1, CDR2, and CDR3 regions comprised in SEQ ID NO: 223;

(e9) CDR1, CDR2, and CDR3 comprised in the antibody variable region of (1) in [2-1] and identical to the amino acid sequences of the CDR1, CDR2, and CDR3 regions comprised in SEQ ID NO: 211; CDR1, CDR2, and CDR3 comprised in the antibody variable region of (2) in [2-1] and identical to the amino acid sequences of the CDR1, CDR2, and CDR3 regions comprised in SEQ ID NO: 142; and CDR1, CDR2, and CDR3 comprised in the antibody variable region of the common L chain and identical to the amino acid sequences of the CDR1, CDR2, and CDR3 regions comprised in SEQ ID NO: 223;

(e10) CDR1, CDR2, and CDR3 comprised in the antibody variable region of (1) in [2-1] and identical to the amino acid sequences of the CDR1, CDR2, and CDR3 regions comprised in SEQ ID NO: 211; CDR1, CDR2, and CDR3 comprised in the antibody variable region of (2) in [2-1] and identical to the amino acid sequences of the CDR1, CDR2, and CDR3 regions comprised in SEQ ID NO: 142; and CDR1, CDR2, and CDR3 comprised in the antibody variable region of the common L chain and identical to the amino acid sequences of the CDR1, CDR2, and CDR3 regions comprised in SEQ ID NO: 299;

(e11) CDR1, CDR2, and CDR3 comprised in the antibody variable region of (1) in [2-1] and identical to the amino acid sequences of the CDR1, CDR2, and CDR3 regions comprised in SEQ ID NO: 211; CDR1, CDR2, and CDR3 comprised in the antibody variable region of (2) in [2-1] and identical to the amino acid sequences of the CDR1, CDR2, and CDR3 regions comprised in SEQ ID NO: 144; and CDR1, CDR2, and CDR3 comprised in the antibody variable region of the common L chain and identical to the amino acid sequences of the CDR1, CDR2, and CDR3 regions comprised in SEQ ID NO: 223;

(e12) CDR1, CDR2, and CDR3 comprised in the antibody variable region of (1) in [2-1] and identical to the amino acid sequences of the CDR1, CDR2, and CDR3 regions comprised in SEQ ID NO: 211; CDR1, CDR2, and CDR3 comprised in the antibody variable region of (2) in [2-1] and identical to the amino acid sequences of the CDR1, CDR2, and CDR3 regions comprised in SEQ ID NO: 164; and CDR1, CDR2, and CDR3 comprised in the antibody variable region of the common L chain and identical to the amino acid sequences of the CDR1, CDR2, and CDR3 regions comprised in SEQ ID NO: 223;

(e13) CDR1, CDR2, and CDR3 comprised in the antibody variable region of (1) in [2-1] and identical to the amino acid sequences of the CDR1, CDR2, and CDR3 regions comprised in SEQ ID NO: 211; CDR1, CDR2, and CDR3 comprised in the antibody variable region of (2) in [2-1] and identical to the amino acid sequences of the CDR1, CDR2, and CDR3 regions comprised in SEQ ID NO: 168; and CDR1, CDR2, and CDR3 comprised in the antibody variable region of the common L chain and identical to the amino acid sequences of the CDR1, CDR2, and CDR3 regions comprised in SEQ ID NO: 223;

(e14) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 53;

(e15) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 299;

(e16) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 301;

(e17) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 302;

(e18) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 304;

(e19) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 306;

(e20) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 307;

(e21) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 103; and CDR1, CDR2, and CDR3 comprised in the antibody variable region of the common L chain and identical to the amino acid sequences of the CDR1, CDR2, and CDR3 regions comprised in SEQ ID NO: 309;

(e22) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 122; and CDR1, CDR2, and CDR3 comprised in the antibody variable region of the common L chain and identical to the amino acid sequences of the CDR1, CDR2, and CDR3 regions comprised in SEQ ID NO: 53;

(e23) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 129; and CDR1, CDR2, and CDR3 comprised in the antibody variable region of the common L chain and identical to the amino acid sequences of the CDR1, CDR2, and CDR3 regions comprised in SEQ ID NO: 53;

(e24) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 132; and CDR1, CDR2, and CDR3 comprised in the antibody variable region of the common L chain and identical to the amino acid sequences of the CDR1, CDR2, and CDR3 regions comprised in SEQ ID NO: 53; and (e25) CDR1, CDR2, and CDR3 comprised in the antibody variable region of (1) in [2-1] and identical to the amino acid sequences of the CDR1, CDR2, and CDR3 regions comprised in SEQ ID NO: 215; CDR1, CDR2, and CDR3 comprised in the antibody variable region of (2) in [2-1] and identical to the amino acid sequences of the CDR1, CDR2, and CDR3 regions comprised in SEQ ID NO: 424; and CDR1, CDR2, and CDR3 comprised in the antibody variable region of the common L chain and identical to the amino acid sequences of the CDR1, CDR2, and CDR3 regions comprised in SEQ ID NO: 53.

[2-15] The anticancer agent of any one of [2-1] to [2-4], wherein the antibody variable regions of (1) and (2) of [2-1] and the common L chain variable region are antibody variable regions comprising any one of the combinations of variable regions selected from (f1) to (f26) below, or antibody variable regions functionally equivalent thereto:

(f1) an H-chain variable region comprised in the antibody variable region of (1) in [2-1] and identical to the amino acid sequence of SEQ ID NO: 197; an H-chain variable region comprised in the antibody variable region of (2) in [2-1] and identical to the amino acid sequence of SEQ ID NO: 128; and an antibody variable region of the common L chain identical to the amino acid sequence of the variable region comprised in SEQ ID NO: 53;

(f2) an H-chain variable region comprised in the antibody variable region of (1) in [2-1] and identical to the amino acid sequence of SEQ ID NO: 197; an H-chain variable region comprised in the antibody variable region of (2) in [2-1] and identical to the amino acid sequence of SEQ ID NO: 128; and an antibody variable region of the common L chain identical to the amino acid sequence of the variable region comprised in SEQ ID NO: 299;

(f3) an H-chain variable region comprised in the antibody variable region of (1) in [2-1] and identical to the amino acid sequence of SEQ ID NO: 197; an H-chain variable region comprised in the antibody variable region of (2) in [2-1] and identical to the amino acid sequence of SEQ ID NO: 128; and an antibody variable region of the common L chain identical to the amino acid sequence of the variable region comprised in SEQ ID NO: 310;

(f4) an H-chain variable region comprised in the antibody variable region of (1) in [2-1] and identical to the amino acid sequence of SEQ ID NO: 197; an H-chain variable region comprised in the antibody variable region of (2) in [2-1] and identical to the amino acid sequence of SEQ ID NO: 128; and an antibody variable region of the common L chain identical to the amino acid sequence of the variable region comprised in SEQ ID NO: 319;

(f5) an H-chain variable region comprised in the antibody variable region of (1) in [2-1] and identical to the amino acid sequence of SEQ ID NO: 206; an H-chain variable region comprised in the antibody variable region of (2) in [2-1] and identical to the amino acid sequence of SEQ ID NO: 142; and an antibody variable region of the common L chain and identical to the amino acid sequence of the variable region comprised in SEQ ID NO: 223;

(f6) an H-chain variable region comprised in the antibody variable region of (1) in [2-1] and identical to the amino acid sequence of SEQ ID NO: 206; an H-chain variable region comprised in the antibody variable region of (2) in [2-1] and identical to the amino acid sequence of SEQ ID NO: 144; and an antibody variable region of the common L chain identical to the amino acid sequence of the variable region comprised in SEQ ID NO: 223;

(f7) an H-chain variable region comprised in the antibody variable region of (1) in [2-1] and identical to the amino acid sequence of SEQ ID NO: 206; an H-chain variable region comprised in the antibody variable region of (2) in [2-1] and identical to the amino acid sequence of SEQ ID NO: 164; and an antibody variable region of the common L chain and identical to the amino acid sequence of the variable region comprised in SEQ ID NO: 223;

(f8) an H-chain variable region comprised in the antibody variable region of (1) in [2-1] and identical to the amino acid sequence of SEQ ID NO: 206; an H-chain variable region comprised in the antibody variable region of (2) in [2-1] and identical to the amino acid sequence of SEQ ID NO: 168; and an antibody variable region of the common L chain identical to the amino acid sequence of the variable region comprised in SEQ ID NO: 223;

(f9) an H-chain variable region comprised in the antibody variable region of (1) in [2-1] and identical to the amino acid sequence of SEQ ID NO: 211; an H-chain variable region comprised in the antibody variable region of (2) in [2-1] and identical to the amino acid sequence of SEQ ID NO: 142; and an antibody variable region of the common L chain identical to the amino acid sequence of the variable region comprised in SEQ ID NO: 223;

(f10) an H-chain variable region comprised in the antibody variable region of (1) in [2-1] and identical to the amino acid sequence of SEQ ID NO: 211; an H-chain variable region comprised in the antibody variable region of (2) in [2-1] and identical to the amino acid sequence of SEQ ID NO: 142; and an antibody variable region of the common L chain identical to the amino acid sequence of the variable region comprised in SEQ ID NO: 299;

(f11) an H-chain variable region comprised in the antibody variable region of (1) in [2-1] and identical to the amino acid sequence of SEQ ID NO: 211; an H-chain variable region comprised in the antibody variable region of (2) in [2-1] and identical to the amino acid sequence of SEQ ID NO: 144; and an antibody variable region of the common L chain identical to the amino acid sequence of the variable region comprised in SEQ ID NO: 223;

(f12) an H-chain variable region comprised in the antibody variable region of (1) in [2-1] and identical to the amino acid sequence of SEQ ID NO: 211; an H-chain variable region comprised in the antibody variable region of (2) in [2-1] and identical to the amino acid sequence of SEQ ID NO: 164; and an antibody variable region of the common L chain identical to the amino acid sequence of the variable region comprised in SEQ ID NO: 223;

(f13) an H-chain variable region comprised in the antibody variable region of (1) in [2-1] and identical to the amino acid sequence of SEQ ID NO: 211; an H-chain variable region comprised in the antibody variable region of (2) in [2-1] and identical to the amino acid sequence of SEQ ID NO: 168; and an antibody variable region of the common L chain identical to the amino acid sequence of the variable region comprised in SEQ ID NO: 223;

(f14) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 53;

(f15) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 299;

(f16) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 301;

(f17) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 302;

(f18) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 304;

(f19) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 306;

(f20) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 307;

(f21) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 103; and an antibody variable region of the common L chain identical to the amino acid sequence of the variable region comprised in SEQ ID NO: 309;

(f22) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 122; and an antibody variable region of the common L chain identical to the amino acid sequence of the variable region comprised in SEQ ID NO: 53;

(f23) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 129; and an antibody variable region of the common L chain and identical to the amino acid sequence of the variable region comprised in SEQ ID NO: 53;

(f24) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 132; and an antibody variable region of the common L chain and identical to the amino acid sequence of the variable region comprised in SEQ ID NO: 53;

(f25) an H-chain variable region comprised in the antibody variable region of (1) in [2-1] and identical to the amino acid sequence of SEQ ID NO: 215; an H-chain variable region comprised in the antibody variable region of (2) in [2-1] and identical to the amino acid sequence of SEQ ID NO: 424; and an antibody variable region of the common L chain and identical to the amino acid sequence of the variable region comprised in SEQ ID NO: 53; and (f26) multispecific antigen-binding molecule that binds to an epitope overlapping with each of the epitopes on glypican 3 and T-cell receptor complex bound by the multispecific antigen-binding molecule of any one of (f1) to (f25), and which has a common L chain.

[2-16] The anticancer agent of any one of [2-1] to [2-15], wherein the Fc region of (3) in [2-1] is an Fc region with an amino acid mutation at any of the Fc region-constituting amino acids of SEQ ID NOs: 23 to 26 (IgG1 to IgG4).

[2-17] The anticancer agent of [2-16], wherein the Fc region of (3) in [2-1] is an Fc region with mutation of at least one amino acid selected from the following amino acid positions specified by EU numbering:
position 220, position 226, position 229, position 231, position 232, position 233, position 234, position 235, position 236, position 237, position 238, position 239, position 240, position 264, position 265, position 266, position 267, position 269, position 270, position 295, position 296, position 297, position 298, position 299, position 300, position 325, position 327, position 328, position 329, position 330, position 331, and position 332.

[2-18] The anticancer agent of [2-16], wherein the Fc region of (3) in [2-1] is an Fc region comprising at least one amino acid selected from the following amino acids specified by EU numbering: Arg at amino acid position 234, Ala or Arg at amino acid position 235, Lys at amino acid position 239, and Ala at amino acid position 297.

[2-19] The anticancer agent of any one of [2-16] to [2-18], wherein the Fc region of (3) in [2-1] further comprises an amino acid mutation for promoting formation of a heterodimeric Fc region.

[2-20] The anticancer agent of [2-19], wherein the heterodimeric Fc region is the amino acid sequence combination of (g1) or (g2) below:

(g1) a combination of an amino acid sequence identical to the Fc region of a constant region comprising the amino acid sequence of SEQ ID NO: 57, and an amino acid sequence identical to the Fc region of a constant region comprising the amino acid sequence of SEQ ID NO: 58; and (g2) a combination of an amino acid sequence identical to the Fc region of a constant region comprising the amino acid sequence of SEQ ID NO: 60 or 62, and an amino acid sequence identical to the Fc region of a constant region comprising the amino acid sequence of SEQ ID NO: 61.

[2-21] The anticancer agent of any one of [2-1] to [2-20], wherein the multispecific antigen-binding molecule is a bispecific antibody.

[2-22] An anticancer agent comprising as an active ingredient a bispecific antibody of any one of (h1) to (h25) below:

(h1) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 424 and a constant region having the amino acid sequence of SEQ ID NO: 60 or 62; and a common antibody L chain having the amino acid sequence of SEQ ID NO: 53;

(h2) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 53;

(h3) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 299;

(h4) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 301;

(h5) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 302;

(h6) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 304;

(h7) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 306;

(h8) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 307;

(h9) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 103 and a constant region having the amino acid sequence of SEQ ID NO: 60 or 62; and a common antibody L chain having the amino acid sequence of SEQ ID NO: 309;

(h10) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 122 and a constant region having the amino acid sequence of SEQ ID NO: 60 or 62; and a common antibody L chain having the amino acid sequence of SEQ ID NO: 53;

(h11) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 129 and a constant region having the amino acid sequence of SEQ ID NO: 60 or 62; and a common antibody L chain having the amino acid sequence of SEQ ID NO: 53;

(h12) a bispecific antibody having an antibody H chain having glypican 3-binding activity that comprises an antibody H-chain variable region having the amino acid sequence of SEQ ID NO: 215 and a constant region having the amino acid sequence of SEQ ID NO: 61; an antibody H chain having T-cell receptor complex-binding activity that comprises an antibody H-chain variable region having the amino acid sequence of SEQ ID NO: 132 and a constant region having the amino acid sequence of SEQ ID NO: 60 or 62; and a common antibody L chain having the amino acid sequence of SEQ ID NO: 53;

(h13) a bispecific antibody having an antibody H chain having glypican 3-binding activity that comprises an antibody H-chain variable region having the amino acid sequence of SEQ ID NO: 197 and a constant region having the amino acid sequence of SEQ ID NO: 61; an antibody H chain having T-cell receptor complex-binding activity that comprises an antibody H-chain variable region having the amino acid sequence of SEQ ID NO: 128 and a constant region having the amino acid sequence of SEQ ID NO: 60 or 62; and a common antibody L chain having the amino acid sequence of SEQ ID NO: 299;

(h14) a bispecific antibody having an antibody H chain having glypican 3-binding activity that comprises an antibody H-chain variable region having the amino acid sequence of SEQ ID NO: 197 and a constant region having the amino acid sequence of SEQ ID NO: 61; an antibody H chain having T-cell receptor complex-binding activity that comprises an antibody H-chain variable region having the amino acid sequence of SEQ ID NO: 128 and a constant region having the amino acid sequence of SEQ ID NO: 60 or 62; and a common antibody L chain having the amino acid sequence of SEQ ID NO: 310;

(h15) a bispecific antibody having an antibody H chain having glypican 3-binding activity that comprises an antibody H-chain variable region having the amino acid sequence of SEQ ID NO: 197 and a constant region having the amino acid sequence of SEQ ID NO: 61; an antibody H chain having T-cell receptor complex-binding activity that comprises an antibody H-chain variable region having the amino acid sequence of SEQ ID NO: 128 and a constant region having the amino acid sequence of SEQ ID NO: 60 or 62; and a common antibody L chain having the amino acid sequence of SEQ ID NO: 319;

(h16) a bispecific antibody having an antibody H chain having glypican 3-binding activity that comprises an antibody H-chain variable region having the amino acid sequence of SEQ ID NO: 197 and a constant region having the amino acid sequence of SEQ ID NO: 61; an antibody H chain having T-cell receptor complex-binding activity that comprises an antibody H-chain variable region having the amino acid sequence of SEQ ID NO: 128 and a constant region having the amino acid sequence of SEQ ID NO: 60 or 62; and a common antibody L chain having the amino acid sequence of SEQ ID NO: 53;

(h17) a bispecific antibody having an antibody H chain having glypican 3-binding activity that comprises an antibody H-chain variable region having the amino acid sequence of SEQ ID NO: 211 and a constant region having the amino acid sequence of SEQ ID NO: 61; an antibody H chain having T-cell receptor complex-binding activity that comprises an antibody H-chain variable region having the amino acid sequence of SEQ ID NO: 142 and a constant region having the amino acid sequence of SEQ ID NO: 60 or 62; and a common antibody L chain having the amino acid sequence of SEQ ID NO: 299;

(h18) a bispecific antibody having an antibody H chain having glypican 3-binding activity that comprises an antibody H-chain variable region having the amino acid sequence of SEQ ID NO: 211 and a constant region having the amino acid sequence of SEQ ID NO: 61; an antibody H chain having T-cell receptor complex-binding activity that comprises an antibody H-chain variable region having the amino acid sequence of SEQ ID NO: 142 and a constant region having the amino acid sequence of SEQ ID NO: 60 or 62; and a common antibody L chain having the amino acid sequence of SEQ ID NO: 223;

(h19) a bispecific antibody having an antibody H chain having glypican 3-binding activity that comprises an antibody H-chain variable region having the amino acid sequence of SEQ ID NO: 211 and a constant region having the amino acid sequence of SEQ ID NO: 61; an antibody H chain having T-cell receptor complex-binding activity that comprises an antibody H-chain variable region having the amino acid sequence of SEQ ID NO: 144 and a constant region having the amino acid sequence of SEQ ID NO: 60 or 62; and a common antibody L chain having the amino acid sequence of SEQ ID NO: 223;

(h20) a bispecific antibody having an antibody H chain having glypican 3-binding activity that comprises an antibody H-chain variable region having the amino acid sequence of SEQ ID NO: 206 and a constant region having the amino acid sequence of SEQ ID NO: 61; an antibody H chain having T-cell receptor complex-binding activity that comprises an antibody H-chain variable region having the amino acid sequence of SEQ ID NO: 144 and a constant region having the amino acid sequence of SEQ ID NO: 60 or 62; and a common antibody L chain having the amino acid sequence of SEQ ID NO: 223;

(h21) a bispecific antibody having an antibody H chain having glypican 3-binding activity that comprises an antibody H-chain variable region having the amino acid sequence of SEQ ID NO: 206 and a constant region having the amino acid sequence of SEQ ID NO: 61; an antibody H chain having T-cell receptor complex-binding activity that comprises an antibody H-chain variable region having the amino acid sequence of SEQ ID NO: 142 and a constant region having the amino acid sequence of SEQ ID NO: 60 or 62; and a common antibody L chain having the amino acid sequence of SEQ ID NO: 223;

(h22) a bispecific antibody having an antibody H chain having glypican 3-binding activity that comprises an antibody H-chain variable region having the amino acid sequence of SEQ ID NO: 206 and a constant region having the amino acid sequence of SEQ ID NO: 61; an antibody H chain having T-cell receptor complex-binding activity that comprises an antibody H-chain variable region having the amino acid sequence of SEQ ID NO: 164 and a constant region having the amino acid sequence of SEQ ID NO: 60 or 62; and a common antibody L chain having the amino acid sequence of SEQ ID NO: 223;

(h23) a bispecific antibody having an antibody H chain having glypican 3-binding activity that comprises an antibody H-chain variable region having the amino acid sequence of SEQ ID NO: 206 and a constant region having the amino acid sequence of SEQ ID NO: 61; an antibody H chain having T-cell receptor complex-binding activity that comprises an antibody H-chain variable region having the amino acid sequence of SEQ ID NO: 168 and a constant region having the amino acid sequence of SEQ ID NO: 60 or 62; and a common antibody L chain having the amino acid sequence of SEQ ID NO: 223;

(h24) a bispecific antibody having an antibody H chain having glypican 3-binding activity that comprises an antibody H-chain variable region having the amino acid sequence of SEQ ID NO: 211 and a constant region having the amino acid sequence of SEQ ID NO: 61; an antibody H chain having T-cell receptor complex-binding activity that comprises an antibody H-chain variable region having the amino acid sequence of SEQ ID NO: 164 and a constant region having the amino acid sequence of SEQ ID NO: 60 or 62; and a common antibody L chain having the amino acid sequence of SEQ ID NO: 223; and (h25) a bispecific antibody having an antibody H chain having glypican 3-binding activity that comprises an antibody H-chain variable region having the amino acid sequence of SEQ ID NO: 211 and a constant region having the amino acid sequence of SEQ ID NO: 61; an antibody H chain having T-cell receptor complex-binding activity that comprises an antibody H-chain variable region having the amino acid sequence of SEQ ID NO: 168 and a constant region having the amino acid sequence of SEQ ID NO: 60 or 62; and a common antibody L chain having the amino acid sequence of SEQ ID NO: 223.

Furthermore, the present invention relates to an anticancer agent comprising as an active ingredient a multispecific antigen-binding molecule which comprises the following domains:

(3-1) a domain comprising an antibody variable region having glypican 3-binding activity;

(3-2) a domain comprising an antibody variable region having T-cell receptor complex-binding activity; wherein the L-chain variable regions contained in the variable regions of (3-1) and (3-2) have a commonly shared amino acid sequence. The present invention also relates to an anticancer agent comprising as an active ingredient the domain of (3-1), which is more specifically a domain that comprises antibody heavy-chain and/or light-chain variable regions having glypican 3-binding activity, and which is comprised in the multispecific antigen-binding molecule. The present invention additionally relates to an anticancer agent comprising as an active ingredient the domain of (3-2), which is more specifically a domain that comprises an antibody variable region having T-cell receptor complex-binding activity, and which is comprised in the multispecific antigen-binding molecule. Details of the domains of (3-1) and (3-2) may include those described in [2-1] to [2-22] mentioned above. The multispecific antigen-binding molecule may be a bispecific antibody. Furthermore, the multispecific antigen-binding molecule may further comprise a domain comprising an Fc region, and the Fc region may have a reduced Fcγ receptor-binding activity. Details of the domain comprising an Fc region may include those described in [2-1] to [2-22] mentioned above. Furthermore, the present invention relates to an anticancer agent comprising the multispecific antigen-binding molecule and a pharmaceutically acceptable carrier. The anticancer agent may induce cytotoxicity, the cytotoxicity may be T-cell-dependent cellular cytotoxicity, and the agent may be for administration to a patient in need of the multispecific antigen-binding molecule.

The present invention also provides an anticancer agent comprising as an active ingredient a multispecific antigen-binding molecule that binds to epitopes overlapping and/or competing with epitopes on each of glypican 3 and T-cell receptor complex bound by the multispecific antigen-binding molecule of any one of (e1) to (e25) of [2-14] mentioned above, and a multispecific antigen-binding molecule that binds to epitopes overlapping and/or competing with epitopes on each of glypican 3 and T-cell receptor complex bound by the multispecific antigen-binding molecule of any one of (f1) to (f25) of [2-15].

Regarding (g1) and (g2) of [2-20] mentioned above, of the two Fc regions, the former Fc region may be included in the antibody H chain having glypican 3-binding activity and the latter Fc region may be included in the antibody H chain having T-cell receptor complex-binding activity; or the former Fc region may be included in the antibody H chain having T-cell receptor complex-binding activity and the latter Fc region may be included in the antibody H chain having glypican 3-binding activity.

The present invention also provides anticancer agents comprising as an active ingredient a bispecific antibody that binds to epitopes overlapping and/or competing with epitopes on each of glypican 3 and T-cell receptor complex bound by a bispecific antibody which has the antibody H chain of SEQ ID NO: 385 having glypican 3-binding activity, the antibody H chain of SEQ ID NO: 402 having CD3-binding activity, and the common antibody L chains of SEQ ID NO: 410.

The following inventions are also provided:

[4-1] A pharmaceutical composition comprising another anticancer agent as an active ingredient, the pharmaceutical composition being used in combination with a bispecific antibody of any one of (a) to (c) below:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-2] The pharmaceutical composition of [4-1], wherein said another anticancer agent is administered simultaneously with the bispecific antibody.

[4-3] The pharmaceutical composition of [4-1], wherein said another anticancer agent is administered before or after administration of the bispecific antibody.

[4-4] A pharmaceutical composition for treating or preventing cancer, comprising a combination of a bispecific antibody of any one of (a) to (c) below and another anticancer agent:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-5] The pharmaceutical composition of [4-4], which is a combination preparation.

[4-6] The pharmaceutical composition of [4-4], wherein the bispecific antibody and said another anticancer agent are administered separately.

[4-7] The pharmaceutical composition of [4-6], wherein the bispecific antibody and said another anticancer agent are administered simultaneously or sequentially.

[4-8] The pharmaceutical composition of any one of [4-1] to [4-7], wherein said another anticancer agent is a chemotherapeutic agent, a T cell-activating agonist agent, an immune checkpoint inhibitor, or an angiogenic inhibitor.

[4-9] The pharmaceutical composition of any one of [4-1] to [4-8], which is for treating or preventing any cancer selected from the group consisting of gastric cancer, head and neck cancer, esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer, anus cancer, central nervous system tumor, neuroendocrine tissue tumor, penis cancer, pleura tumor, salivary gland tumor, vulva cancer, thymoma, and childhood cancer.

[4-10] An agent for inducing cytotoxicity, an agent for suppressing cell proliferation, an agent for inhibiting cell proliferation, an agent for activating immune response, an agent for treating cancer, or an agent for preventing cancer, which comprises the pharmaceutical composition of any one of [4-1] to [4-9].

The following inventions are also provided:

[4-11] A combination of a bispecific antibody of any one of (a) to (c) below and another anticancer agent:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-12] The combination of [4-11], wherein the bispecific antibody is administered simultaneously with said another anticancer agent.

[4-13] The combination of [4-11], wherein the bispecific antibody is administered before or after administration of said another anticancer agent.

[4-14] The combination of any one of [4-11] to [4-13], wherein said another anticancer agent is a chemotherapeutic agent, a T cell-activating agonist agent, an immune checkpoint inhibitor, or an angiogenic inhibitor.

[4-15] The combination of any one of [4-11] to [4-14], which is for treating or preventing any cancer selected from the group consisting of gastric cancer, head and neck cancer, esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer, anus cancer, central nervous system tumor, neuroendocrine tissue tumor, penis cancer, pleura tumor, salivary gland tumor, vulva cancer, thymoma, and childhood cancer.

[4-16] An agent for inducing cytotoxicity, an agent for suppressing cell proliferation, an agent for inhibiting cell proliferation, an agent for activating immune response, an agent for treating cancer, or an agent for preventing cancer, which comprises the combination of any one of [4-11] to [4-15].

The following inventions are also provided:

[4-17] A method for inducing cytotoxicity, for suppressing cell proliferation, for inhibiting cell proliferation, for activating immune response, for treating cancer, or for preventing cancer in an individual, comprising administering an effective amount of a bispecific antibody of any one of (a) to (c) below and an effective amount of another anticancer agent:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-18] A method for inducing cytotoxicity, for suppressing cell proliferation, for inhibiting cell proliferation, for activating immune response, for treating cancer, or for preventing cancer in an individual with combined use of a bispecific antibody of any one of (a) to (c) below, comprising administering to the individual an effective amount of another anticancer agent:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-19] A method for inducing cytotoxicity, for suppressing cell proliferation, for inhibiting cell proliferation, for activating immune response, for treating cancer, or for preventing cancer in an individual with combined use of another anticancer agent, comprising administering to the individual an effective amount of a bispecific antibody of any one of (a) to (c) below;

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-20] A method for enhancing effects of inducing cytotoxicity, suppressing cell proliferation, inhibiting cell proliferation, activating immune response, treating cancer, or preventing cancer in an individual by a bispecific antibody of any one of (a) to (c) below, comprising administering an effective amount of another anticancer agent to the individual:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-21] A method for enhancing effects of inducing cytotoxicity, suppressing cell proliferation, inhibiting cell proliferation, activating immune response, treating cancer, or preventing cancer in an individual by another anticancer agent, comprising administering an effective amount of a bispecific antibody of any one of (a) to (c) below:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-22] The method of any one of [4-17] to [4-21], wherein the bispecific antibody and said another anticancer agent are administrated separately.

[4-23] The method of any one of [4-17] to [4-22], wherein the bispecific antibody and said another anticancer agent are administrated simultaneously or sequentially.

[4-24] The method of any one of [4-17] to [4-23], wherein said another anticancer agent is a chemotherapeutic agent, a T cell-activating agonist agent, an immune checkpoint inhibitor, or an angiogenic inhibitor.

[4-25] The method of any one of [4-17] to [4-24], wherein the cancer is any cancer selected from the group consisting of gastric cancer, head and neck cancer, esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer, anus cancer, central nervous system tumor, neuroendocrine tissue tumor, penis cancer, pleura tumor, salivary gland tumor, vulva cancer, thymoma, and childhood cancer.

The following inventions are also provided:

[4-26] A kit comprising:
(A) a pharmaceutical composition comprising a bispecific antibody of any one of (a) to (c) below;
(B) a container; and
(C) an instruction or a label indicating that the bispecific antibody and at least one type of another anticancer agent are administrated in combination to an individual for treating or preventing cancer in the individual;

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-27] A kit comprising:
(A) another anticancer agent;
(B) a container; and
(C) an instruction or a label indicating that said another anticancer agent and a pharmaceutical composition comprising at least one type of a bispecific antibody of (a) to (c) below are administered in combination to an individual for treating or preventing cancer in the individual;

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-28] A kit comprising:
(A) a pharmaceutical composition comprising a bispecific antibody of any one of (a) to (c) below:

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410;
(B) a container; and
(C) another anticancer agent.

[4-29] The kit of any one of [4-26] to [4-28], wherein the bispecific antibody is administered simultaneously with said another anticancer agent.

[4-30] The kit of any one of [4-26] to [4-28], wherein the bispecific antibody is administered before or after administration of said another anticancer agent.

[4-31] The kit of any one of [4-26] to [4-30], wherein said another anticancer agent is a chemotherapeutic agent, a T cell-activating agonist agent, an immune checkpoint inhibitor, or an angiogenic inhibitor.

[4-32] The kit of any one of [4-26] to [4-31], wherein the cancer is any cancer selected from the group consisting of gastric cancer, head and neck cancer, esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer, anus cancer, central nervous system tumor, neuroendocrine tissue tumor, penis cancer, pleura tumor, salivary gland tumor, vulva cancer, thymoma, and childhood cancer.

The following inventions are also provided:
[4-33] A method for inducing damage to a cancer cell or a cancer cell-comprising tumor tissue, or a method for suppressing proliferation of a cancer cell or growth of a cancer cell-comprising tumor tissue, by contacting a cancer cell with a bispecific antibody of any one of (a) to (c) below and another anticancer agent;

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-34] A method for assessing whether a bispecific antibody and another anticancer agent induce damage to a cancer cell or a cancer cell-comprising tumor tissue, or suppress proliferation of a cancer cell or growth of a cancer cell-comprising tumor tissue, by contacting a cancer cell with the bispecific antibody of any one of (a) to (c) below and another anticancer agent;

(a) a bispecific antibody that comprises an antibody variable region having glypican 3-binding activity and an antibody variable region having CD3-binding activity, wherein CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody that comprises an antibody variable region having glypican 3-binding activity and an antibody variable region having CD3-binding activity, wherein the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody that comprises an antibody variable region having glypican 3-binding activity and an antibody variable region having CD3-binding activity, wherein the bispecific antibody has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and antibody common L chains having at least 80% identity to the amino acid sequence of SEQ ID NO: 410.

[4-35] The method of [4-33] or [4-34], wherein said another anticancer agent is a chemotherapeutic agent, a T cell-activating agonist agent, an immune checkpoint inhibitor, or an angiogenic inhibitor.

[4-36] The method of any one of [4-33] to [4-35], wherein the cancer cell is any cancer cell selected from the group consisting of gastric cancer, head and neck cancer, esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer, anus cancer, central nervous system tumor, neuroendocrine tissue tumor, penis cancer, pleura tumor, salivary gland tumor, vulva cancer, thymoma, and childhood cancer.

The following inventions are also provided:

[5-1] The pharmaceutical composition of any one of [7] to [12] and [4-1] to [4-9], which is for increasing and/or maintaining the expression of CD3ε chain in an individual as compared to administration of the bispecific antibody of any one of [7] (a) to (c) or said another anticancer agent alone.

[5-2] The pharmaceutical composition of any one of [7] to [12] and [4-1] to [4-9], which is for expanding T cell population in an individual as compared to administration of the bispecific antibody of any one of [7] (a) to (c) or said another anticancer agent alone.

[5-3] The pharmaceutical composition of [5-2], wherein the T cell population is an activated T cell population.

[5-4] The pharmaceutical composition of any one of [7] to [12] and [4-1] to [4-9], which is for increasing the expression of a cytokine and/or chemokine in an individual as compared to administration of the bispecific antibody of any one of [7] (a) to (c) or said another anticancer agent alone.

[5-5] The pharmaceutical composition of [5-4], wherein the cytokine and/or chemokine is one or more cytokines and/or chemokines selected from the group consisting of IFNγ, IL2, IL6, IL7, IL8, IL10, IL17A, TNF, CXCL9, and CXCL10.

[5-6] The pharmaceutical composition of any one of [7] to [12] and [4-1] to [4-9], which is for increasing the expression of a gene involved in cell death in an individual as compared to administration of the bispecific antibody of any one of [7] (a) to (c) or said another anticancer agent alone.

[5-7] The pharmaceutical composition of [5-6], wherein the gene involved in cell death is one or more genes selected from the group consisting of TNFSF10, FAS, FASL, caspase 8, and caspase 7.

[5-8] The pharmaceutical composition of any one of [7] to [12] and [4-1] to [4-9], which is for inhibiting a gene involved in cell cycle promotion in an individual as compared to administration of the bispecific antibody of any one of [7] (a) to (c) or said another anticancer agent alone.

[5-9] The pharmaceutical composition of [5-8], wherein the gene involved in cell cycle promotion is one or more genes selected from the group consisting of PCNA, CCNA2, and CDK4.

[5-10] The pharmaceutical composition of any one of [7] to [12] and [4-1] to [4-9], which is for increasing the expression of a gene involved in cell cycle suppression in an individual as compared to administration of the bispecific antibody of any one of [7] (a) to (c) or said another anticancer agent alone.

[5-11] The pharmaceutical composition of [5-10], wherein the gene involved in cell cycle suppression is p21.

[5-12] The pharmaceutical composition of any one of [7] to [12] and [4-1] to [4-9], which is for increasing a leukocyte marker in an individual as compared to administration of the bispecific antibody of any one of [7] (a) to (c) or said another anticancer agent alone.

[5-13] The pharmaceutical composition of [5-12], wherein the leukocyte marker is CD45.

[5-14] The pharmaceutical composition of any one of [7] to [12] and [4-1] to [4-9], which is for increasing a T cell marker and/or T cell activation marker in an individual as compared to administration of the bispecific antibody of any one of [7] (a) to (c) or said another anticancer agent alone.

[5-15] The pharmaceutical composition of [5-14], wherein the T cell marker and/or T cell activation marker is one or more T cell markers and/or T cell activation markers selected from the group consisting of CD3, CD4, CD8a, GZB, PRF1, and IFNγ.

[5-16] The pharmaceutical composition of any one of [7] to [12] and [4-1] to [4-9], which is for increasing the expression of an immune checkpoint gene in an individual as compared to administration of the bispecific antibody of any one of [7] (a) to (c) or said another anticancer agent alone.

[5-17] The pharmaceutical composition of [5-16], wherein the immune checkpoint gene is one or more immune checkpoint genes selected from the group consisting of PD-L1, PD-1, TIM3, LAG3, and CTLA4.

In each item of [4-1] to [4-36] above, "another anticancer agent" refers to an anticancer agent which comprises as an active ingredient a substance that is different from the bispecific antibody recited in each item. Specifically, the term "another anticancer agent" merely indicates that the invention of each item is specified as inventions in which the other/another anticancer agent is an anticancer agent comprising as an active ingredient a substance that is different from the bispecific antibody, and the invention is not limited to inventions in which the bispecific antibody is used as an anticancer agent. For example, even when each invention of [4-1] to [4-36] recites the term "another anticancer agent", the invention also includes embodiments where no other anticancer agent than the "another anticancer agent" is used, and in this case, the invention includes embodiments where the bispecific antibody is used as an enhancer, combination drug, excipient, or such for the other anticancer agent.

Effects of the Invention

The present invention provides novel multispecific antigen-binding molecules with molecular forms that can be produced with high efficiency, which maintain the strong antitumor activity possessed by BiTE and the excellent safety property of not causing cancer antigen-independent induction of a cytokine storm and such, and have long half-lives in blood. Anticancer agents which comprise a multispecific antigen-binding molecule of the present invention as an active ingredient and combination therapies using the multispecific antigen-binding molecule and another anticancer agent target cancer tissues containing glypican 3-expressing cancer cells to cause cytotoxicity, and can treat or prevent various cancers. The invention enables desirable treatment which has not only a high level of safety but also reduced physical burden, and is highly convenient for patients.

BRIEF DESCRIPTION OF THE DRAWINGS

FIG. 7 is graphs showing the anti-tumor activities resulting from a single or combination of antibody, and capecitabine, cisplatin, or paclitaxel against MKN45 xenograft tumor in a human T cell transplantation model.

FIG. 12 shows schematic diagrams of a: ERY22 and b: ERY27.

FIG. 23 shows the relationship between the amino acid residues constituting the Fc regions of IgG1, IgG2, IgG3, and IgG4, and the Kabat EU numbering system (herein, also referred to as EU INDEX).

FIG. 24A shows the heavy-chain variable region sequences and their numbering according to Kabat et al. Residues 1 to 79 of the heavy-chain variable region sequences of CE115HA000 (SEQ ID NO: 52), TR01H040 (SEQ ID NO: 103), TR01H071 (SEQ ID NO: 132), TR01H082 (SEQ ID NO: 142), TR01H084 (SEQ ID NO: 144), TR01H109 (SEQ ID NO: 164), TR01H113 (SEQ ID NO: 168), H0000 (SEQ ID NO: 40), H0610 (SEQ ID NO: 215), GCH054 (SEQ ID NO: 197), GCH065 (SEQ ID NO: 206), and GCH094 (SEQ ID NO: 211) are shown.

FIG. 24B shows the heavy-chain variable region sequences and their numbering according to Kabat et al. Residues 80 to 113 of the heavy-chain variable region sequences of CE115HA000 (SEQ ID NO: 52), TR01H040 (SEQ ID NO: 103), TR01H071 (SEQ ID NO: 132), TR01H082 (SEQ ID NO: 142), TR01H084 (SEQ ID NO: 144), TR01H109 (SEQ ID NO: 164), TR01H113 (SEQ ID NO: 168), H0000 (SEQ ID NO: 40), H0610 (SEQ ID NO: 215), GCH054 (SEQ ID NO: 197), GCH065 (SEQ ID NO: 206), and GCH094 (SEQ ID NO: 211) are shown.

FIG. 25 shows the light-chain variable region sequences and their numbering according to Kabat et al. Light-chain variable region sequences of L0000 (SEQ ID NO: 53), L0011 (SEQ ID NO: 223), L0201 (SEQ ID NO: 299), L0203 (SEQ ID NO: 301), L0204 (SEQ ID NO: 302), L0206 (SEQ ID NO: 304), L0208 (SEQ ID NO: 306), L0209 (SEQ ID NO: 307), L0211 (SEQ ID NO: 309), L0212 (SEQ ID NO: 310), L0222 (SEQ ID NO: 319) and L0272 (SEQ ID NO: 359) are shown.

FIG. 28 presents the representative examples of PCR analyses of genotypes of ES cell clones obtained by introducing into mouse Cd3 gene-modified ES cells the human CD3 gene region introduction vector along with a Cre expression vector and a Dre expression vector. FIG. 28B presents the representative examples of PCR results that detect the introduction of the human CD3 gene region.

FIG. 32 presents the representative examples of immunohistological staining for CD3 performed on the thymus (A) and spleen (B) of each established line of human CD3 gene-substituted mice (C3, 8112, and 4HH3). In both tissues, staining was observed only in the T cell zone as in the wild-type mouse. Furthermore, staining was not observed in the Cd3 gene-deficient mice, and this showed that the staining in the human CD3 gene-substituted mice is due to the expression of the introduced human CD3 genes.

MODE FOR CARRYING OUT THE INVENTION

Figure 1A:
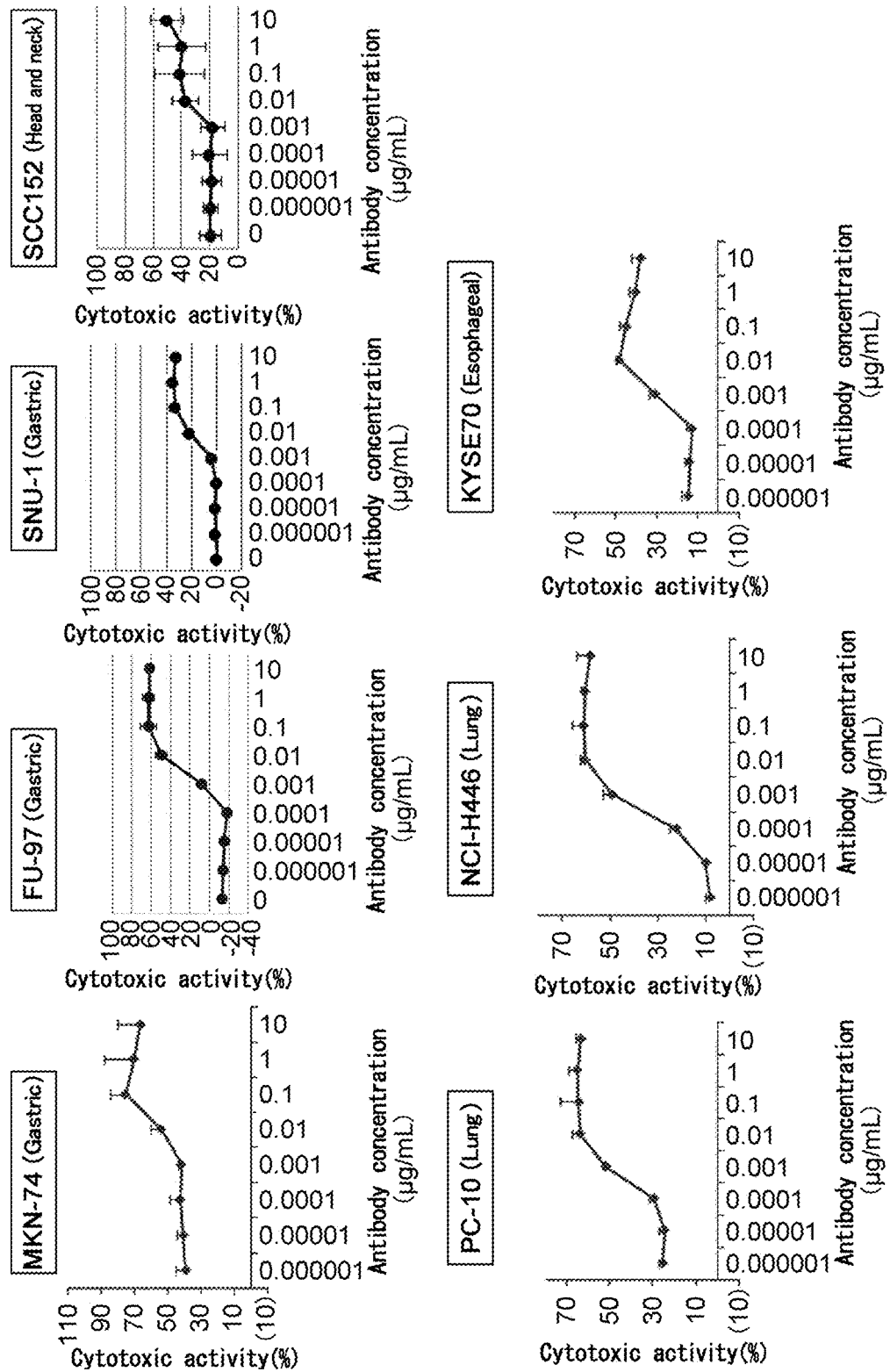
FIG. 1A is graphs showing the cytotoxic activity of antibody-38 when cell lines derived from various cancer types are used as target cells.

The definitions below are provided to help understanding of the present invention illustrated herein.

Antibody

Herein, "antibody" refers to a natural immunoglobulin or an immunoglobulin produced by partial or complete synthesis. Antibodies can be isolated from natural sources such as naturally-occurring plasma and serum, or culture supernatants of antibody-producing hybridomas. Alternatively, antibodies can be partially or completely synthesized using techniques such as genetic recombination. Preferred antibodies include, for example, antibodies of an immunoglobulin isotype or subclass belonging thereto. Known human immunoglobulins include antibodies of the following nine classes (isotypes): IgG1, IgG2, IgG3, IgG4, IgA1, IgA2, IgD, IgE, and IgM. Of these isotypes, antibodies of the present invention may include IgG1, IgG2, IgG3, and IgG4.

Methods for producing an antibody with desired binding activity are known to those skilled in the art. Below is an example that describes a method for producing an antibody (anti-GPC3 antibody) that binds to Glypican-3 (hereinafter, also referred to as GPC3), which belongs to the GPI-anchored receptor family (Int J Cancer. (2003) 103(4), 455-65). Antibodies that bind to a T-cell receptor complex can also be produced according to the example described below.

Anti-GPC3 antibodies can be obtained as polyclonal or monoclonal antibodies using known methods. The anti-GPC3 antibodies preferably produced are monoclonal antibodies derived from mammals. Such mammal-derived monoclonal antibodies include antibodies produced by hybridomas or host cells transformed with an expression vector carrying an antibody gene by genetic engineering techniques.

Monoclonal antibody-producing hybridomas can be produced using known techniques, for example, as described below. Specifically, mammals are immunized by conventional immunization methods using a GPC3 protein as a sensitizing antigen. Resulting immune cells are fused with known parental cells by conventional cell fusion methods. Then, hybridomas producing an anti-GPC3 antibody can be selected by screening for monoclonal antibody-producing cells using conventional screening methods.

Specifically, monoclonal antibodies are prepared as mentioned below. First, the GPC3 gene whose nucleotide sequence is disclosed in RefSeq accession number NM_001164617.1 (SEQ ID NO: 1) can be expressed to produce a GPC3 protein shown in RefSeq accession number NP_001158089.1 (SEQ ID NO: 2), which will be used as a sensitizing antigen for antibody preparation. That is, a gene sequence encoding GPC3 is inserted into a known expression vector, and appropriate host cells are transformed with this vector. The desired human GPC3 protein is purified from the host cells or their culture supernatants by known methods. For example, to prepare soluble GPC3 from culture supernatants, amino acids at positions 564 to 580 that form the hydrophobic region corresponding to the GPI-anchor sequence used to anchor GPC3 on the cell membrane are deleted from the GPC3 polypeptide sequence of SEQ ID NO: 2, and then the resulting protein is expressed instead of the GPC3 protein of SEQ ID NO: 2. Alternatively, it is possible to use a purified natural GPC3 protein as a sensitizing antigen.

The purified GPC3 protein can be used as a sensitizing antigen for use in immunization of mammals. Partial peptides of GPC3 can also be used as sensitizing antigens. In this case, the partial peptides may also be obtained by chemical synthesis from the human GPC3 amino acid sequence. Furthermore, they may also be obtained by incorporating a portion of the GPC3 gene into an expression vector and expressing it. Moreover, they may also be obtained by degrading the GPC3 protein using proteases, but the region and size of the GPC3 peptide used as the partial peptide are not particularly limited to a special embodiment. As the preferred region, any sequence from the amino acid sequence corresponding to the amino acids at positions 524 to 563, or more preferably any sequence from the amino acid sequence corresponding to the amino acids at positions 537 to 563 in the amino acid sequence of SEQ ID NO: 2 may be selected. Preferably, any sequence may be selected from the amino acid sequence of the region not containing the amino acid sequence corresponding to amino acids at positions 550 to 663 in the amino acid sequence of SEQ ID NO: 2. Preferably, any sequence may be selected from the amino acid sequence corresponding to positions 544 to 553, and more preferably, any sequence may be selected from the amino acid sequence corresponding to positions 546 to 551 in the amino acid sequence of SEQ ID NO: 2. The number of amino acids constituting a peptide to be used as the sensitizing antigen is at least five or more, or preferably for example, six or more, or seven or more. More specifically, peptides consisting of 8 to 50 residues or preferably 10 to 30 residues may be used as the sensitizing antigen.

For sensitizing antigen, alternatively it is possible to use a fusion protein prepared by fusing a desired partial polypeptide or peptide of the GPC3 protein with a different polypeptide. For example, antibody Fc fragments and peptide tags are preferably used to produce fusion proteins to be used as sensitizing antigens. Vectors for expression of such fusion proteins can be constructed by fusing in frame genes encoding two or more desired polypeptide fragments and inserting the fusion gene into an expression vector as described above. Methods for producing fusion proteins are described in Molecular Cloning 2nd ed. (Sambrook, J et al., Molecular Cloning 2nd ed., 9.47-9.58 (1989) Cold Spring Harbor Lab. Press). Methods for preparing GPC3 to be used as a sensitizing antigen, and immunization methods using GPC3 are specifically described in WO 2003/000883, WO 2004/022754, and WO 2006/006693.

There is no particular limitation on the mammals to be immunized with the sensitizing antigen. However, it is preferable to select the mammals by considering their compatibility with the parent cells to be used for cell fusion. In general, rodents such as mice, rats, and hamsters, rabbits, and monkeys are preferably used.

The above animals are immunized with a sensitizing antigen by known methods. Generally performed immunization methods include, for example, intraperitoneal or subcutaneous injection of a sensitizing antigen into mammals. Specifically, a sensitizing antigen is appropriately diluted with PBS (Phosphate-Buffered Saline), physiological saline, or the like. If desired, a conventional adjuvant such as Freund's complete adjuvant is mixed with the antigen, and the mixture is emulsified. Then, the sensitizing antigen is administered to a mammal several times at 4- to 21-day intervals. Appropriate carriers may be used in immunization with the sensitizing antigen. In particular, when a low-molecular-weight partial peptide is used as the sensitizing antigen, it is sometimes desirable to couple the sensitizing antigen peptide to a carrier protein such as albumin or keyhole limpet hemocyanin for immunization.

Alternatively, hybridomas producing a desired antibody can be prepared using DNA immunization as mentioned below. DNA immunization is an immunization method that confers immunostimulation by expressing a sensitizing antigen in an animal immunized as a result of administering a vector DNA constructed to allow expression of an antigen protein-encoding gene in the animal. As compared to conventional immunization methods in which a protein antigen is administered to animals to be immunized, DNA immunization is expected to be superior in that:

immunostimulation can be provided while retaining the structure of a membrane protein such as GPC3; and there is no need to purify the antigen for immunization.

In order to prepare a monoclonal antibody of the present invention using DNA immunization, first, a DNA expressing a GPC3 protein is administered to an animal to be immunized. The GPC3-encoding DNA can be synthesized by known methods such as PCR. The obtained DNA is inserted into an appropriate expression vector, and then this is administered to an animal to be immunized. Preferably used expression vectors include, for example, commercially-available expression vectors such as pcDNA3.1. Vectors can be administered to an organism using conventional methods. For example, DNA immunization is performed by using a gene gun to introduce expression vector-coated gold particles into cells in the body of an animal to be immunized. Antibodies that recognized GPC3 can also be produced by the methods described in WO 2003/104453.

After immunizing a mammal as described above, an increase in the titer of a GPC3-binding antibody is confirmed in the serum. Then, immune cells are collected from the mammal, and then subjected to cell fusion. In particular, splenocytes are preferably used as immune cells.

A mammalian myeloma cell is used as a cell to be fused with the above-mentioned immunocyte. The myeloma cells preferably comprise a suitable selection marker for screening. A selection marker confers characteristics to cells for their survival (or death) under a specific culture condition. Hypoxanthine-guanine phosphoribosyltransferase deficiency (hereinafter abbreviated as HGPRT deficiency) and thymidine kinase deficiency (hereinafter abbreviated as TK deficiency) are known as selection markers. Cells with HGPRT or TK deficiency have hypoxanthine-aminopterin-thymidine sensitivity (hereinafter abbreviated as HAT sensitivity). HAT-sensitive cells cannot synthesize DNA in a HAT selection medium, and are thus killed. However, when the cells are fused with normal cells, they can continue DNA synthesis using the salvage pathway of the normal cells, and therefore they can grow even in the HAT selection medium.

HGPRT-deficient and TK-deficient cells can be selected in a medium containing 6-thioguanine, 8-azaguanine (hereinafter abbreviated as 8AG), or 5'-bromodeoxyuridine, respectively. Normal cells are killed because they incorporate these pyrimidine analogs into their DNA. Meanwhile, cells that are deficient in these enzymes can survive in the selection medium, since they cannot incorporate these pyrimidine analogs. In addition, a selection marker referred to as G418 resistance provided by the neomycin-resistant gene confers resistance to 2-deoxystreptamine antibiotics (gentamycin analogs). Various types of myeloma cells that are suitable for cell fusion are known.

For example, myeloma cells including the following cells can be preferably used:
P3(P3x63Ag8.653) (J. Immunol. (1979) 123 (4), 1548-1550);
P3x63Ag8U.1 (Current Topics in Microbiology and Immunology (1978)81, 1-7);
NS-1 (C. Eur. J. Immunol. (1976)6 (7), 511-519);
MPC-11 (Cell (1976) 8 (3), 405-415);
SP2/0 (Nature (1978) 276 (5685), 269-270);
FO (J. Immunol. Methods (1980) 35 (1-2), 1-21);
S194/5.XX0.BU.1 (J. Exp. Med. (1978) 148 (1), 313-323);
R210 (Nature (1979) 277 (5692), 131-133), etc.

Cell fusions between the immunocytes and myeloma cells are essentially carried out using known methods, for example, a method by Kohler and Milstein et al. (Methods Enzymol. (1981) 73: 3-46).

More specifically, cell fusion can be carried out, for example, in a conventional culture medium in the presence of a cell fusion-promoting agent. The fusion-promoting agents include, for example, polyethylene glycol (PEG) and Sendai virus (HVJ). If required, an auxiliary substance such as dimethyl sulfoxide is also added to improve fusion efficiency.

The ratio of immunocytes to myeloma cells may be determined at one's own discretion, preferably, for example, one myeloma cell for every one to ten immunocytes. Culture media to be used for cell fusions include, for example, media that are suitable for the growth of myeloma cell lines, such as RPMI1640 medium and MEM medium, and other conventional culture medium used for this type of cell culture. In addition, serum supplements such as fetal calf serum (FCS) may be preferably added to the culture medium.

For cell fusion, predetermined amounts of the above immune cells and myeloma cells are mixed well in the above culture medium. Then, a PEG solution (for example, the average molecular weight is about 1,000 to 6,000) pre-warmed to about 37° C. is added thereto at a concentration of generally 30% to 60% (w/v). This is gently mixed to produce desired fusion cells (hybridomas). Then, an appropriate culture medium mentioned above is gradually added to the cells, and this is repeatedly centrifuged to remove the supernatant. Thus, cell fusion agents and such which are unfavorable to hybridoma growth can be removed.

The hybridomas thus obtained can be selected by culture using a conventional selective medium, for example, HAT medium (a culture medium containing hypoxanthine, aminopterin, and thymidine). Cells other than the desired hybridomas (non-fused cells) can be killed by continuing culture in the above HAT medium for a sufficient period of time. Typically, the period is several days to several weeks. Then, hybridomas producing the desired antibody are screened and singly cloned by conventional limiting dilution methods.

The hybridomas thus obtained can be selected using a selection medium based on the selection marker possessed by the myeloma used for cell fusion. For example, HGPRT- or TK-deficient cells can be selected by culture using the HAT medium (a culture medium containing hypoxanthine, aminopterin, and thymidine). Specifically, when HAT-sensitive myeloma cells are used for cell fusion, cells successfully fused with normal cells can selectively proliferate in the HAT medium. Cells other than the desired hybridomas (non-fused cells) can be killed by continuing culture in the above HAT medium for a sufficient period of time. Specifically, desired hybridomas can be selected by culture for generally several days to several weeks. Then, hybridomas producing the desired antibody may be screened and singly cloned by conventional limiting dilution methods.

Desired antibodies can be preferably selected and singly cloned by screening known methods based on antigen/antibody reaction. For example, a GPC3-binding monoclonal antibody can bind to GPC3 expressed on the cell surface. Such a monoclonal antibody can be screened by fluorescence activated cell sorting (FACS). FACS is a system that assesses the binding of an antibody to cell surface by analyzing cells contacted with a fluorescent antibody using laser beam, and measuring the fluorescence emitted from individual cells.

To screen for hybridomas that produce a monoclonal antibody of the present invention by FACS, GPC3-expressing cells are first prepared. Cells preferably used for screening are mammalian cells in which GPC3 is forcedly expressed. As control, the activity of an antibody to bind to cell-surface GPC3 can be selectively detected using non-transformed mammalian cells as host cells. Specifically, hybridomas producing an anti-GPC3 monoclonal antibody can be isolated by selecting hybridomas that produce an antibody which binds to cells forced to express GPC3, but not to host cells.

Alternatively, the activity of an antibody to bind to immobilized GPC3-expressing cells can be assessed based on the principle of ELISA. For example, GPC3-expressing cells are immobilized to the wells of an ELISA plate. Culture supernatants of hybridomas are contacted with the immobilized cells in the wells, and antibodies that bind to the immobilized cells are detected. When the monoclonal antibodies are derived from mouse, antibodies bound to the cells can be detected using an anti-mouse immunoglobulin antibody. Hybridomas producing a desired antibody having the antigen-binding ability are selected by the above screening, and they can be cloned by a limiting dilution method or the like.

Monoclonal antibody-producing hybridomas thus prepared can be passaged in a conventional culture medium, and stored in liquid nitrogen for a long period.

The above hybridomas are cultured by a conventional method, and desired monoclonal antibodies can be prepared from the culture supernatants. Alternatively, the hybridomas are administered to and grown in compatible mammals, and monoclonal antibodies are prepared from the ascites. The former method is suitable for preparing antibodies with high purity.

Antibodies encoded by antibody genes that are cloned from antibody-producing cells such as the above hybridomas can also be preferably used. A cloned antibody gene is inserted into an appropriate vector, and this is introduced into a host to express the antibody encoded by the gene. Methods for isolating antibody genes, inserting the genes into vectors, and transforming host cells have already been established, for example, by Vandamme et al. (Eur. J. Biochem. (1990) 192(3), 767-775). Methods for producing recombinant antibodies are also known as described below.

For example, a cDNA encoding the variable region (V region) of an anti-GPC3 antibody is prepared from hybridoma cells expressing the anti-GPC3 antibody. For this purpose, total RNA is first extracted from hybridomas. Methods used for extracting mRNAs from cells include, for example:

the guanidine ultracentrifugation method (Biochemistry (1979) 18(24), 5294-5299), and the AGPC method (Anal. Biochem. (1987) 162(1), 156-159)

Extracted mRNAs can be purified using the mRNA Purification Kit (GE Healthcare Bioscience) or such. Alternatively, kits for extracting total mRNA directly from cells, such as the QuickPrep mRNA Purification Kit (GE Healthcare Bioscience), are also commercially available. mRNAs can be prepared from hybridomas using such kits. cDNAs encoding the antibody V region can be synthesized from the prepared mRNAs using a reverse transcriptase. cDNAs can be synthesized using the AMV Reverse Transcriptase First-strand cDNA Synthesis Kit (Seikagaku Co.) or such. Furthermore, the SMART RACE cDNA amplification kit (Clontech) and the PCR-based 5'-RACE method (Proc. Natl. Acad. Sci. USA (1988) 85(23), 8998-9002; Nucleic Acids Res. (1989) 17(8), 2919-2932) can be appropriately used to synthesize and amplify cDNAs. In such a cDNA synthesis process, appropriate restriction enzyme sites described below may be introduced into both ends of a cDNA.

The cDNA fragment of interest is purified from the resulting PCR product, and then this is ligated to a vector DNA. A recombinant vector is thus constructed, and introduced into E. coli or such. After colony selection, the desired recombinant vector can be prepared from the colony-forming E. coli. Then, whether the recombinant vector has the cDNA nucleotide sequence of interest is tested by a known method such as the dideoxy nucleotide chain termination method.

The 5'-RACE method which uses primers to amplify the variable region gene is conveniently used for isolating the gene encoding the variable region. First, a 5'-RACE cDNA library is constructed by cDNA synthesis using RNAs extracted from hybridoma cells as a template. A commercially available kit such as the SMART RACE cDNA amplification kit is appropriately used to synthesize the 5'-RACE cDNA library.

The antibody gene is amplified by PCR using the prepared 5'-RACE cDNA library as a template. Primers for amplifying the mouse antibody gene can be designed based on known antibody gene sequences. The nucleotide sequences of the primers vary depending on the immunoglobulin subclass. Therefore, it is preferable that the subclass is determined in advance using a commercially available kit such as the Iso Strip mouse monoclonal antibody isotyping kit (Roche Diagnostics).

Specifically, for example, primers that allow amplification of genes encoding γ1, γ2a, γ2b, and γ3 heavy chains and κ and λ light chains can be used to isolate mouse IgG-encoding genes. In general, a primer that anneals to a constant region site close to the variable region is used as a 3'-side primer to amplify an IgG variable region gene. Meanwhile, a primer attached to a 5' RACE cDNA library construction kit is used as a 5'-side primer.

PCR products thus amplified are used to reconstruct immunoglobulins composed of a combination of heavy and light chains. A desired antibody can be selected using the GPC3-binding activity of a reconstructed immunoglobulin as an indicator. For example, when the objective is to isolate an antibody against GPC3, it is more preferred that the binding of the antibody to GPC3 is specific. A GPC3-binding antibody can be screened, for example, by the following steps:

(1) contacting a GPC3-expressing cell with an antibody comprising the V region encoded by a cDNA isolated from a hybridoma;

(2) detecting the binding of the antibody to the GPC3-expressing cell; and (3) selecting an antibody that binds to the GPC3-expressing cell.

Methods for detecting the binding of an antibody to GPC3-expressing cells are known. Specifically, the binding of an antibody to GPC3-expressing cells can be detected by the above-described techniques such as FACS. Immobilized samples of GPC3-expressing cells are appropriately used to assess the binding activity of an antibody.

Preferred antibody screening methods that use the binding activity as an indicator also include panning methods using phage vectors. Screening methods using phage vectors are advantageous when the antibody genes are isolated from heavy-chain and light-chain subclass libraries from a polyclonal antibody-expressing cell population. Genes encoding the heavy-chain and light-chain variable regions can be linked by an appropriate linker sequence to form a single-chain Fv (scFv). Phages presenting scFv on their surface can be produced by inserting a gene encoding scFv into a phage vector. The phages are contacted with an antigen of interest. Then, a DNA encoding scFv having the binding activity of interest can be isolated by collecting phages bound to the antigen. This process can be repeated as necessary to enrich scFv having a desired binding activity.

After isolation of the cDNA encoding the V region of the anti-GPC3 antibody of interest, the cDNA is digested with restriction enzymes that recognize the restriction sites introduced into both ends of the cDNA. Preferred restriction enzymes recognize and cleave a nucleotide sequence that occurs in the nucleotide sequence of the antibody gene at a low frequency. Furthermore, a restriction site for an enzyme that produces a cohesive end is preferably introduced into a vector to insert a single-copy digested fragment in the correct orientation. The cDNA encoding the V region of the anti-GPC3 antibody is digested as described above, and this is inserted into an appropriate expression vector to construct an antibody expression vector. In this case, if a gene encoding the antibody constant region (C region) and a gene encoding the above V region are fused in-frame, a chimeric antibody is obtained. Herein, "chimeric antibody" means that the origin of the constant region is different from that of the variable region. Thus, in addition to mouse/human heterochimeric antibodies, human/human allochimeric antibodies are included in the chimeric antibodies of the present invention. A chimeric antibody expression vector can be constructed by inserting the above V region gene into an expression vector that already has the constant region. Specifically, for example, a recognition sequence for a restriction enzyme that excises the above V region gene can be appropriately placed on the 5' side of an expression vector carrying a DNA encoding a desired antibody constant region (C region). A chimeric antibody expression vector is constructed by fusing in frame the two genes digested with the same combination of restriction enzymes.

To produce an anti-GPC3 monoclonal antibody, antibody genes are inserted into an expression vector so that the genes are expressed under the control of an expression regulatory region. The expression regulatory region for antibody expression includes, for example, enhancers and promoters. Furthermore, an appropriate signal sequence may be attached to the amino terminus so that the expressed antibody is secreted to the outside of cells. In the Reference Examples described below, a peptide having the amino acid sequence MGWSCIILFLVATATGVHS (SEQ ID NO: 3) is used as a signal sequence. Meanwhile, other appropriate signal sequences may be attached. The expressed polypeptide is cleaved at the carboxyl terminus of the above sequence, and the resulting polypeptide is secreted to the outside of cells as a mature polypeptide. Then, appropriate host cells are transformed with the expression vector, and recombinant cells expressing the anti-GPC3 antibody-encoding DNA are obtained.

DNAs encoding the antibody heavy chain (H chain) and light chain (L chain) are separately inserted into different expression vectors to express the antibody gene. An antibody molecule having the H and L chains can be expressed by co-transfecting the same host cell with vectors into which the H-chain and L-chain genes are respectively inserted. Alternatively, host cells can be transformed with a single expression vector into which DNAs encoding the H and L chains are inserted (see WO 94/11523).

There are various known host cell/expression vector combinations for antibody preparation by introducing isolated antibody genes into appropriate hosts. All of these expression systems are applicable to isolation of domains including antibody variable regions of the present invention. Appropriate eukaryotic cells used as host cells include animal cells, plant cells, and fungal cells. Specifically, the animal cells include, for example, the following cells.
(1) mammalian cells: CHO, COS, myeloma, baby hamster kidney (BHK), HeLa, Vero, or such;
(2) amphibian cells: *Xenopus* oocytes, or such; and
(3) insect cells: sf9, sf21, Tn5, or such.

In addition, as a plant cell, an antibody gene expression system using cells derived from the *Nicotiana* genus such as *Nicotiana tabacum* is known. Callus cultured cells can be appropriately used to transform plant cells.

Furthermore, the following cells can be used as fungal cells:
yeasts: the *Saccharomyces* genus such as *Saccharomyces cerevisiae*, and the *Pichia* genus such as *Pichia pastoris*; and filamentous fungi: the *Aspergillus* genus such as *Aspergillus niger*.

Furthermore, antibody gene expression systems that utilize prokaryotic cells are also known. For example, when using bacterial cells, *E. coli* cells, *Bacillus subtilis* cells, and such can suitably be utilized in the present invention. Expression vectors carrying the antibody genes of interest are introduced into these cells by transfection. The transfected cells are cultured in vitro, and the desired antibody can be prepared from the culture of transformed cells.

In addition to the above-described host cells, transgenic animals can also be used to produce a recombinant antibody. That is, the antibody can be obtained from an animal into which the gene encoding the antibody of interest is introduced. For example, the antibody gene can be constructed as a fusion gene by inserting in frame into a gene that encodes a protein produced specifically in milk. Goat β-casein or such can be used, for example, as the protein secreted in milk. DNA fragments containing the fused gene inserted with the antibody gene is injected into a goat embryo, and then this embryo is introduced into a female goat. Desired antibodies can be obtained as a protein fused with the milk protein from milk produced by the transgenic goat born from the embryo-recipient goat (or progeny thereof). In addition, to increase the volume of milk containing the desired antibody produced by the transgenic goat, hormones can be administered to the transgenic goat as necessary (Ebert, K. M. et al., BioTechnology (1994) 12 (7), 699-702).

When an antigen-binding molecule described herein is administered to human, a domain derived from a genetically recombinant antibody that has been artificially modified to reduce the heterologous antigenicity against human and such, can be appropriately used as the domain of the antigen-binding molecule including an antibody variable region. Such genetically recombinant antibodies include, for example, humanized antibodies. These modified antibodies are appropriately produced by known methods.

An antibody variable region used to produce a domain of an antigen-binding molecule including an antibody variable region described herein is generally formed by three complementarity-determining regions (CDRs) that are separated by four framework regions (FRs). CDR is a region that substantially determines the binding specificity of an antibody. The amino acid sequences of CDRs are highly diverse. On the other hand, the FR-forming amino acid sequences often have high identity even among antibodies with different binding specificities. Therefore, generally, the binding specificity of a certain antibody can be introduced to another antibody by CDR grafting.

A humanized antibody is also called a reshaped human antibody. Specifically, humanized antibodies prepared by grafting the CDR of a non-human animal antibody such as a mouse antibody to a human antibody and such are known. Common genetic engineering techniques for obtaining humanized antibodies are also known. Specifically, for example, overlap extension PCR is known as a method for grafting a mouse antibody CDR to a human FR. In overlap extension PCR, a nucleotide sequence encoding a mouse antibody CDR to be grafted is added to primers for synthesizing a human antibody FR. Primers are prepared for each of the four FRs. It is generally considered that when grafting a mouse CDR to a human FR, selecting a human FR that has high identity to a mouse FR is advantageous for maintaining the CDR function. That is, it is generally preferable to use a human FR comprising an amino acid sequence which has high identity to the amino acid sequence of the FR adjacent to the mouse CDR to be grafted.

Nucleotide sequences to be ligated are designed so that they will be connected to each other in frame. Human FRs are individually synthesized using the respective primers. As a result, products in which the mouse CDR-encoding DNA is attached to the individual FR-encoding DNAs are obtained. Nucleotide sequences encoding the mouse CDR of each product are designed so that they overlap with each other. Then, complementary strand synthesis reaction is conducted to anneal the overlapping CDR regions of the products synthesized using a human antibody gene as template. Human FRs are ligated via the mouse CDR sequences by this reaction.

The full length V region gene, in which three CDRs and four FRs are ultimately ligated, is amplified using primers that anneal to its 5'- or 3'-end, which are added with suitable restriction enzyme recognition sequences. An expression vector for humanized antibody can be produced by inserting the DNA obtained as described above and a DNA that encodes a human antibody C region into an expression vector so that they will ligate in frame. After the recombinant vector is transfected into a host to establish recombinant cells, the recombinant cells are cultured, and the DNA encoding the humanized antibody is expressed to produce the humanized antibody in the cell culture (see, European Patent Publication No. EP 239400 and International Patent Publication No. WO 1996/002576).

By qualitatively or quantitatively measuring and evaluating the antigen-binding activity of the humanized antibody produced as described above, one can suitably select human antibody FRs that allow CDRs to form a favorable antigen-binding site when ligated through the CDRs. Amino acid residues in FRs may be substituted as necessary, so that the CDRs of a reshaped human antibody form an appropriate antigen-binding site. For example, amino acid sequence mutations can be introduced into FRs by applying the PCR method used for grafting a mouse CDR into a human FR. More specifically, partial nucleotide sequence mutations can be introduced into primers that anneal to the FR. Nucleotide sequence mutations are introduced into the FRs synthesized by using such primers. Mutant FR sequences having the desired characteristics can be selected by measuring and evaluating the activity of the amino acid-substituted mutant antibody to bind to the antigen by the above-mentioned method (Sato, K. et al., Cancer Res. (1993) 53: 851-856).

Alternatively, desired human antibodies can be obtained by immunizing transgenic animals having the entire repertoire of human antibody genes (see International Patent Publication Nos. WO 1993/012227; WO 1992/003918; WO 1994/002602; WO 1994/025585; WO 1996/034096; WO 1996/033735) by DNA immunization.

Furthermore, techniques for preparing human antibodies by panning using human antibody libraries are also known. For example, the V region of a human antibody is expressed as a single-chain antibody (scFv) on phage surface by the phage display method. Phages expressing an scFv that binds to the antigen can be selected. The DNA sequence encoding the human antibody V region that binds to the antigen can be determined by analyzing the genes of selected phages. The DNA sequence of the scFv that binds to the antigen is determined. An expression vector can be prepared by fusing the V region sequence in frame with the C region sequence of a desired human antibody, and inserting this into an appropriate expression vector. The expression vector is introduced into cells appropriate for expression such as those described above. The human antibody can be produced by expressing the human antibody-encoding gene in the cells. These methods are already known (see International Patent Publication Nos. WO 1992/001047; WO 1992/020791; WO 1993/006213; WO 1993/011236; WO 1993/019172; WO 1995/001438; WO 1995/015388).

A Domain Comprising an Antibody Variable Region Having Glypican 3 (GPC3)-Binding Activity Herein, the phrase "a domain comprising an antibody variable region having glypican 3 (GPC3)-binding activity" refers to an antibody portion that comprises a region that specifically binds to the above-mentioned GPC3 protein, or to all or a portion of a partial peptide of the GPC3 protein, and is also complementary thereto. Domains comprising an antibody variable region may be provided from variable domains of one or a plurality of antibodies. Preferably, domains comprising an antibody variable region comprise antibody light-chain and heavy-chain variable regions (VL and VH). Suitable examples of such domains comprising antibody variable regions include "single chain Fv (scFv)", "single chain antibody", "Fv", "single chain Fv 2 (scFv2)", "Fab", "F(ab')2", etc.

A Domain Comprising an Antibody Variable Region Having T-Cell Receptor Complex-Binding Activity Herein, the phrase "a domain comprising an antibody variable region having T-cell receptor complex-binding activity" refers to a T-cell receptor complex-binding antibody portion that comprises a region that specifically binds to all or a portion of a T-cell receptor complex and is also complementary thereto. The T-cell receptor complex may be a T-cell receptor itself, or an adaptor molecule constituting a T-cell receptor complex along with a T-cell receptor. CD3 is suitable as an adaptor molecule.

A Domain Comprising an Antibody Variable Region that has T-Cell Receptor-Binding Activity Herein, the phrase "a domain comprising an antibody variable region having T-cell receptor-binding activity" refers to a T-cell receptor-binding antibody portion produced by including a region that specifically binds to all or a portion of a T-cell receptor and is also complementary thereto.

The portion of a T cell receptor to which the domain of the present invention binds may be a variable region or a constant region, but an epitope present in the constant region is preferred. Examples of the constant region sequence include the T cell receptor α chain of RefSeq Accession No. CAA26636.1 (SEQ ID NO: 4), the T cell receptor β chain of RefSeq Accession No. C25777 (SEQ ID NO: 5), the T cell receptor γ1 chain of RefSeq Accession No. A26659 (SEQ ID NO: 6), the T cell receptor γ2 chain of RefSeq Accession No.

AAB63312.1 (SEQ ID NO: 7), and the T cell receptor δ chain of RefSeq Accession No. AAA61033.1 (SEQ ID NO: 8).

A Domain Comprising an Antibody Variable Region that has CD3-Binding Activity

Herein, the phrase "a domain comprising an antibody variable region that has CD3-binding activity" refers to a CD3-binding antibody portion produced by including a region that specifically binds to all or a portion of CD3 and is also complementary thereto. Preferably, the domain comprises the light-chain and heavy-chain variable regions (VL and VH) of an anti-CD3 antibody. Suitable examples of such a domain include "single chain Fv (scFv)", "single chain antibody", "Fv", "single chain Fv 2 (scFv2)", "Fab", "F(ab') 2", etc.

The domain comprising an antibody variable region that has CD3-binding activity of the present invention may be any epitope-binding domain as long as the epitope exists in the γ-chain, δ-chain, or ε-chain sequence that constitutes human CD3. In the present invention, preferably, a domain comprising an anti-CD3 antibody light-chain variable region (VL) and an anti-CD3 antibody heavy-chain variable region (VH) that bind to an epitope present in the extracellular region of the ε chain of the human CD3 complex is suitably used. Besides the anti-CD3 antibody light chain variable region (VL) and anti-CD3 antibody heavy chain variable region (VH) described in the Reference Examples, various known CD3-binding domains containing a CD3-binding antibody light chain variable region (VL) and a CD3-binding antibody heavy chain variable region (VH), and those of the OKT3 antibody (Proc. Natl. Acad. Sci. USA (1980) 77, 4914-4917) are suitably used as such domains. One may appropriately use an antibody variable region-containing domain derived from the anti-CD3 antibody having desired properties, which is obtained by immunizing a desired animal by the above-mentioned method using the γ-chain, δ-chain, or ε-chain constituting the human CD3. Human antibodies and properly humanized antibodies as described above may be appropriately used as the anti-CD3 antibody to give rise to the domain containing the antibody variable region having CD3-binding activity. Regarding the structure of the γ-chain, δ-chain, or ε-chain constituting CD3, their polynucleotide sequences are shown in SEQ ID NOs: 9 (NM_000073.2), 10 (NM_000732.4), and 11 (NM_000733.3), and their polypeptide sequences are shown in SEQ ID NOs: 12 (NP_000064.1), 13 (NP_000723.1), and 14 (NP_000724.1) (the RefSeq accession number is shown in parentheses).

Antibody variable region-containing domains in antigen binding molecules of the present invention may bind to the same epitope. Herein, the same epitope may be present in a protein comprising the amino acid sequence of SEQ ID NO: 2 or 14. Alternatively, antibody variable region-containing domains in antigen binding molecules of the present invention may bind to different epitopes, respectively. Herein, the different epitopes may be present in a protein comprising the amino acid sequence of SEQ ID NO: 2 or 14.

Specific

The term "specific" means that one of molecules involved in specific binding does not show any significant binding to molecules other than a single or a number of binding partner molecules. Furthermore, the term is also used when a domain containing an antibody variable region is specific to a particular epitope among multiple epitopes in an antigen. When an epitope bound by a domain containing an antibody variable region is included in a number of different antigens, antigen-binding molecules comprising the antibody variable region-containing domain can bind to various antigens that have the epitope.

Epitope

"Epitope" means an antigenic determinant in an antigen, and refers to an antigen site to which a domain of an antigen-binding molecule including an antibody variable region disclosed herein binds. Thus, for example, the epitope can be defined according to its structure. Alternatively, the epitope may be defined according to the antigen-binding activity of an antigen-binding molecule that recognizes the epitope. When the antigen is a peptide or polypeptide, the epitope can be specified by the amino acid residues forming the epitope. Alternatively, when the epitope is a sugar chain, the epitope can be specified by its specific sugar chain structure.

A linear epitope is an epitope that contains an epitope whose primary amino acid sequence is recognized. Such a linear epitope typically contains at least three and most commonly at least five, for example, about 8 to 10 or 6 to 20 amino acids in its specific sequence.

In contrast to the linear epitope, "conformational epitope" is an epitope in which the primary amino acid sequence containing the epitope is not the only determinant of the recognized epitope (for example, the primary amino acid sequence of a conformational epitope is not necessarily recognized by an epitope-defining antibody). Conformational epitopes may contain a greater number of amino acids compared to linear epitopes. A conformational epitope-recognizing antibody recognizes the three-dimensional structure of a peptide or protein. For example, when a protein molecule folds and forms a three-dimensional structure, amino acids and/or polypeptide main chains that form a conformational epitope become aligned, and the epitope is made recognizable by the antibody. Methods for determining epitope conformations include, for example, X ray crystallography, two-dimensional nuclear magnetic resonance, site-specific spin labeling, and electron paramagnetic resonance, but are not limited thereto. See, for example, Epitope Mapping Protocols in Methods in Molecular Biology (1996), Vol. 66, Morris (ed.).

A method for confirming binding to an epitope by a test antigen-binding molecule comprising a domain that contains an antibody variable region having GPC3-binding activity is exemplified below, and a method for confirming binding to an epitope by a test antigen-binding molecule comprising a domain that contains an antibody variable region having T-cell receptor complex-binding activity may also be performed suitably according to the examples below.

For example, recognition of a linear epitope present in the GPC3 molecule by a test antigen-binding molecule comprising a domain that contains an antibody variable region having GPC3-binding activity can be confirmed below. A linear peptide comprising the amino acid sequence constituting the extracellular domain of GPC3 is synthesized for the above-mentioned objective. The peptide may be synthesized chemically. Alternatively, it can be obtained by genetic engineering methods using a region in the cDNA of GPC3 that encodes an amino acid sequence corresponding to the extracellular domain. Next, the binding activity between a linear peptide comprising the amino acid sequence constituting the extracellular domain and the test antigen-binding molecule comprising a domain that contains an antibody variable region having GPC3-binding activity is evaluated. For example, ELISA which uses an immobilized linear peptide as the antigen may enable evaluation of the binding activity of the antigen-binding molecule towards the peptide. Alternatively, binding activity towards the linear peptide may be elucidated based on the level of inhibition caused by the linear peptide in the binding of the antigen-binding molecule to GPC3-expressing cells. These tests may elucidate the binding activity of the antigen-binding molecules toward the linear peptide.

Furthermore, recognition of the three-dimensional structure of the epitope by a test antigen-binding molecule comprising a domain that contains an antibody variable region having GPC3-binding activity can be confirmed below. GPC3-expressing cells are prepared for the above-mentioned objective. For example, when the test antigen-binding molecule comprising a domain that contains an antibody variable region having GPC3-binding activity contacts GPC3-expressing cells, it binds strongly to the cells, but on the other hand, there are cases when the antigen-binding molecule does not substantially bind to the immobilized linear peptide comprising the amino acid sequence constituting the extracellular domain of GPC3. In these cases, "does not substantially bind" refers to a binding activity of 80% or less, generally 50% or less, preferably 30% or less, and particularly preferably 15% or less relative to the binding activity towards human GPC3-expressing cells.

Methods for assaying the binding activity of a test antigen-binding molecule containing a GPC3 antigen-binding domain towards GPC3-expressing cells include, for example, the methods described in Antibodies: A Laboratory Manual (Ed Harlow, David Lane, Cold Spring Harbor Laboratory (1988) 359-420). Specifically, the assessment can be performed based on the principle of ELISA or fluorescence activated cell sorting (FACS) using GPC3-expressing cells as antigen.

In the ELISA format, the binding activity of a test antigen-binding molecule containing a GPC3 antigen-binding domain towards GPC3-expressing cells can be assessed quantitatively by comparing the levels of signal generated by enzymatic reaction. Specifically, a test antigen-binding molecule is added to an ELISA plate onto which GPC3-expressing cells are immobilized. Then, the test antigen-binding molecule bound to the cells is detected using an enzyme-labeled antibody that recognizes the test antigen-binding molecule. Alternatively, when FACS is used, a dilution series of a test antigen-binding molecule is prepared, and the antibody binding titer for GPC3-expressing cells can be determined to compare the binding activity of the test antigen-binding molecule towards GPC3-expressing cells.

The binding of a test antigen-binding molecule towards an antigen expressed on the surface of cells suspended in buffer or the like can be detected using a flow cytometer. Known flow cytometers include, for example, the following devices:

FACSCanto™ II
FACSAria™
FACSArray™
FACSVantage™ SE
FACSCalibur™ (all are trade names of BD Biosciences)
EPICS ALTRA HyPerSort
Cytomics FC 500
EPICS XL-MCL ADC EPICS XL ADC
Cell Lab Quanta/Cell Lab Quanta SC (all are trade names of Beckman Coulter)

Preferable methods for assaying the binding activity of a test antigen-binding molecule containing a GPC3 antigen-binding domain towards an antigen include, for example, the following method. First, GPC3-expressing cells are reacted with a test antigen-binding molecule, and then this is stained with an FITC-labeled secondary antibody that recognizes the polypeptide complex. The test antigen-binding molecule is appropriately diluted with a suitable buffer to prepare the complex at a desired concentration. For example, the complex can be used at a concentration within the range of 10 μg/ml to 10 ng/ml. Then, the fluorescence intensity and cell count are determined using FACSCalibur (BD). The fluorescence intensity obtained by analysis using the CELL QUEST Software (BD), i.e., the Geometric Mean value, reflects the quantity of antibody bound to cells. That is, the binding activity of a test antigen-binding molecule, which is represented by the quantity of the test antigen-binding molecule bound, can be determined by measuring the Geometric Mean value.

Whether a test antigen-binding molecule containing a GPC3 antigen-binding domain shares a common epitope with another antigen-binding molecule can be assessed based on the competition between the two complexes for the same epitope. The competition between antigen-binding molecules can be detected by cross-blocking assay or the like. For example, the competitive ELISA assay is a preferred cross-blocking assay.

Specifically, in cross-blocking assay, the GPC3 protein immobilized to the wells of a microtiter plate is pre-incubated in the presence or absence of a candidate competitor antigen-binding molecule, and then a test antigen-binding molecule is added thereto. The quantity of test antigen-binding molecule bound to the GPC3 protein in the wells is indirectly correlated with the binding ability of a candidate competitor antigen-binding molecule that competes for the binding to the same epitope. That is, the greater the affinity of the competitor antigen-binding molecule for the same epitope, the lower the binding activity of the test antigen-binding molecule towards the GPC3 protein-coated wells.

The quantity of the test antigen-binding molecule bound to the wells via the GPC3 protein can be readily determined by labeling the antigen-binding molecule in advance. For example, a biotin-labeled antigen-binding molecule is measured using an avidin/peroxidase conjugate and appropriate substrate. In particular, cross-blocking assay that uses enzyme labels such as peroxidase is called "competitive ELISA assay". The antigen-binding molecule can also be labeled with other labeling substances that enable detection or measurement. Specifically, radiolabels, fluorescent labels, and such are known.

When the candidate competitor antigen-binding molecule can block the binding by a test antigen-binding molecule containing a GPC3 antigen-binding domain by at least 20%, preferably at least 20 to 50%, and more preferably at least 50% compared to the binding activity in a control experiment conducted in the absence of the competitor antigen-binding molecule, the test antigen-binding molecule is determined to substantially bind to the same epitope bound by the competitor antigen-binding molecule, or compete for the binding to the same epitope.

When the structure of an epitope bound by a test antigen-binding molecule containing a GPC3 antigen-binding domain has already been identified, whether the test and control antigen-binding molecules share a common epitope can be assessed by comparing the binding activities of the two antigen-binding molecules towards a peptide prepared by introducing amino acid mutations into the peptide forming the epitope.

To measure the above binding activities, for example, the binding activities of test and control antigen-binding molecules towards a linear peptide into which a mutation is introduced are compared in the above ELISA format.

Besides the ELISA methods, the binding activity towards the mutant peptide bound to a column can be determined by flowing test and control antigen-binding molecules in the column, and then quantifying the antigen-binding molecule eluted in the elution solution. Methods for adsorbing a mutant peptide to a column, for example, in the form of a GST fusion peptide, are known.

Alternatively, when the identified epitope is a conformational epitope, whether test and control antigen-binding molecules share a common epitope can be assessed by the following method. First, GPC3-expressing cells and cells expressing GPC3 with a mutation introduced into the epitope are prepared. The test and control antigen-binding molecules are added to a cell suspension prepared by suspending these cells in an appropriate buffer such as PBS. Then, the cell suspensions are appropriately washed with a buffer, and an FITC-labeled antibody that recognizes the test and control antigen-binding molecules is added thereto. The fluorescence intensity and number of cells stained with the labeled antibody are determined using FACSCalibur (BD). The test and control polypeptide complexes are appropriately diluted using a suitable buffer, and used at desired concentrations. For example, they may be used at a concentration within the range of 10 µg/ml to 10 ng/ml. The fluorescence intensity determined by analysis using the CELL QUEST Software (BD), i.e., the Geometric Mean value, reflects the quantity of labeled antibody bound to cells. That is, the binding activities of the test and control antigen-binding molecules, which are represented by the quantity of labeled antibody bound, can be determined by measuring the Geometric Mean value.

In the above method, whether an antigen-binding molecule does "not substantially bind to cells expressing mutant GPC3" can be assessed, for example, by the following method. First, the test and control antigen-binding molecules bound to cells expressing mutant GPC3 are stained with a labeled antibody. Then, the fluorescence intensity of the cells is determined. When FACSCalibur is used for fluorescence detection by flow cytometry, the determined fluorescence intensity can be analyzed using the CELL QUEST Software. From the Geometric Mean values in the presence and absence of the antigen-binding molecule, the comparison value (ΔGeo-Mean) can be calculated according to the following formula to determine the ratio of increase in fluorescence intensity as a result of the binding by the antigen-binding molecule.

ΔGeo-Mean=Geo-Mean(in the presence of the antigen-binding molecule)/Geo-Mean(in the absence of the antigen-binding molecule)

The Geometric Mean comparison value (ΔGeo-Mean value for the mutant GPC3 molecule) determined by the above analysis, which reflects the quantity of a test antigen-binding molecule bound to cells expressing mutant GPC3, is compared to the ΔGeo-Mean comparison value that reflects the quantity of the test antigen-binding molecule bound to GPC3-expressing cells. In this case, the concentrations of the test antigen-binding molecule used to determine the ΔGeo-Mean comparison values for GPC3-expressing cells and cells expressing mutant GPC3 are particularly preferably adjusted to be equal or substantially equal. An antigen-binding molecule that has been confirmed to recognize an epitope in GPC3 is used as a control antigen-binding molecule.

If the ΔGeo-Mean comparison value of a test antigen-binding molecule for cells expressing mutant GPC3 is smaller than the ΔGeo-Mean comparison value of the test antigen-binding molecule for GPC3-expressing cells by at least 80%, preferably 50%, more preferably 30%, and particularly preferably 15%, then the test polypeptide complex "does not substantially bind to cells expressing mutant GPC3". The formula for determining the Geo-Mean (Geometric Mean) value is described in the CELL QUEST Software User's Guide (BD biosciences). When the comparison shows that the comparison values are substantially equivalent, the epitope for the test and control antigen-binding molecules can be determined to be the same.

Variable Fragment (Fv)

Herein, the term "variable fragment (Fv)" refers to the minimum unit of an antibody-derived antigen-binding domain that is composed of a pair of the antibody light chain variable region (VL) and antibody heavy chain variable region (VH). In 1988, Skerra and Pluckthun found that homogeneous and active antibodies can be prepared from the E. coli periplasm fraction by inserting an antibody gene downstream of a bacterial signal sequence and inducing expression of the gene in E. coli (Science (1988) 240(4855), 1038-1041). In the Fv prepared from the periplasm fraction, VH associates with VL in a manner so as to bind to an antigen.

Herein, Fv preferably includes, for example, a pair of Fv which is an antigen-binding molecule or such comprising:
(1) a bivalent antigen-binding domain which is a bivalent scFv, wherein one monovalent scFv of the bivalent scFv is linked to one polypeptide forming an Fc domain by a heavy-chain Fv fragment forming a CD3-binding domain, and the other monovalent scFv is linked to the other polypeptide forming an Fc domain by a light-chain Fv fragment forming a CD3-binding domain;
(2) a domain comprising an Fc domain that has no Fcγ receptor-binding activity, and which is derived from amino acids forming the Fc domain of IgG1, IgG2a, IgG3, or IgG4; and
(3) at least a monovalent CD3-binding domain,
wherein the light-chain and heavy-chain Fv fragments associate to form a CD3-binding domain such that it can bind to the CD3 antigen.

scFv, Single-Chain Antibody, and sc(fv)2

Herein, the terms "scFv", "single-chain antibody", and "sc(Fv)2" all refer to an antibody fragment of a single polypeptide chain that contains variable regions derived from the heavy and light chains, but not the constant region. In general, a single-chain antibody also contains a polypeptide linker between the VH and VL domains, which enables formation of a desired structure that is thought to allow antigen binding. The single-chain antibody is discussed in detail by Pluckthun in "The Pharmacology of Monoclonal Antibodies, Vol. 113, Rosenburg and Moore, eds., Springer-Verlag, New York, 269-315 (1994)". See also International Patent Publication WO 1988/001649; U.S. Pat. Nos. 4,946, 778 and 5,260,203. Ina particular embodiment, the single-chain antibody can be bispecific and/or humanized.

scFv is an antigen-binding domain in which VH and VL forming Fv are linked together by a peptide linker (Proc. Natl. Acad. Sci. U.S.A. (1988)85(16), 5879-5883). VH and VL can be retained in close proximity by the peptide linker.

sc(Fv)2 is a single-chain antibody in which four variable regions of two VL and two VH are linked by linkers such as peptide linkers to form a single chain (J Immunol. Methods (1999) 231(1-2), 177-189). The two VH and two VL may be derived from different monoclonal antibodies. Such sc(Fv)2 preferably includes, for example, a bispecific sc(Fv)2 that recognizes two epitopes present in a single antigen as disclosed in the Journal of Immunology (1994) 152(11), 5368-5374. sc(Fv)2 can be produced by methods known to those skilled in the art. For example, sc(Fv)2 can be produced by linking scFv by a linker such as a peptide linker.

Herein, the form of an antigen-binding domain forming an sc(Fv)2 include an antibody in which the two VH units and two VL units are arranged in the order of VH, VL, VH, and VL ([VH]-linker-[VL]-linker-[VH]-linker-[VL]) beginning from the N terminus of a single-chain polypeptide. The order of the two VH units and two VL units is not limited to the above form, and they may be arranged in any order. Example order of the form is listed below.

[VL]-linker-[VH]-linker-[VH]-linker-[VL]
[VH]-linker-[VL]-linker-[VL]-linker-[VH]
[VH]-linker-[VH]-linker-[VL]-linker-[VL]
[VL]-linker-[VL]-linker-[VH]-linker-[VH]
[VL]-linker-[VH]-linker-[VL]-linker-[VH]

The molecular form of sc(Fv)2 is also described in detail in WO 2006/132352. According to these descriptions, those skilled in the art can appropriately prepare desired sc(Fv)2 to produce the antigen-binding molecules disclosed herein.

Furthermore, the antigen-binding molecules of the present invention may be conjugated with a carrier polymer such as PEG or an organic compound such as an anticancer agent. Alternatively, a sugar chain addition sequence is preferably inserted into the polypeptide complexes such that the sugar chain produces a desired effect.

The linkers to be used for linking the variable regions of an antibody comprise arbitrary peptide linkers that can be introduced by genetic engineering, and synthetic linkers disclosed in, for example, Protein Engineering, 9(3), 299-305, 1996. However, peptide linkers are preferred in the present invention. The length of the peptide linkers is not particularly limited, and can be suitably selected by those skilled in the art according to the purpose. The length is preferably five amino acids or more (without particular limitation, the upper limit is generally 30 amino acids or less, preferably 20 amino acids or less), and particularly preferably 15 amino acids. When sc(Fv)2 contains three peptide linkers, their length may be all the same or different.

For example, such peptide linkers include:

Ser

Gly·Ser

Gly·Gly·Ser

Ser·Gly·Gly

Gly·Gly·Gly·Ser (SEQ ID NO: 15)

Ser·Gly·Gly·Gly (SEQ ID NO: 16)

Gly·Gly·Gly·Gly·Ser (SEQ ID NO: 17)

Ser·Gly·Gly·Gly·Gly (SEQ ID NO: 18)

Gly·Gly·Gly·Gly·Gly·Ser (SEQ ID NO: 19)

Ser·Gly·Gly·Gly·Gly·Gly (SEQ ID NO: 20)

Gly·Gly·Gly·Gly·Gly·Gly·Ser (SEQ ID NO: 21)

Ser·Gly·Gly·Gly·Gly·Gly·Gly (SEQ ID NO: 22)

(Gly·Gly·Gly·Gly·Ser)n (SEQ ID NO: 17)

(Ser·Gly·Gly·Gly·Gly)n (SEQ ID NO: 18)

where n is an integer of 1 or larger. The length or sequences of peptide linkers can be selected accordingly by those skilled in the art depending on the purpose.

Synthetic linkers (chemical crosslinking agents) are routinely used to crosslink peptides, and for example:
N-hydroxy succinimide (NHS),
disuccinimidyl suberate (DSS),
bis(sulfosuccinimidyl) suberate ($BS^3$),
dithiobis(succinimidyl propionate) (DSP),
dithiobis(sulfosuccinimidyl propionate) (DTSSP),
ethylene glycol bis(succinimidyl succinate) (EGS),
ethylene glycol bis(sulfosuccinimidyl succinate) (sulfo-EGS),
disuccinimidyl tartrate (DST), disulfosuccinimidyl tartrate (sulfo-DST),
bis[2-(succinimidoxycarbonyloxy)ethyl] sulfone (BSOCOES),
and bis[2-(sulfosuccinimidoxycarbonyloxy)ethyl] sulfone (sulfo-BSOCOES). These crosslinking agents are commercially available.

In general, three linkers are required to link four antibody variable regions together. The linkers to be used may be of the same type or different types.

Fab, F(ab')2, and Fab'

"Fab" consists of a single light chain, and a CH1 domain and variable region from a single heavy chain. The heavy chain of Fab molecule cannot form disulfide bonds with another heavy chain molecule.

"F(ab')2" or "Fab'" is produced by treating an immunoglobulin (monoclonal antibody) with a protease such as pepsin and papain, and refers to an antibody fragment generated by digesting an immunoglobulin (monoclonal antibody) at near the disulfide bonds present between the hinge regions in each of the two H chains. For example, papain cleaves IgG upstream of the disulfide bonds present between the hinge regions in each of the two H chains to generate two homologous antibody fragments, in which an L chain comprising VL (L-chain variable region) and CL (L-chain constant region) is linked to an H-chain fragment comprising VH (H-chain variable region) and CHγ1 (γ1 region in an H-chain constant region) via a disulfide bond at their C-terminal regions. Each of these two homologous antibody fragments is called Fab'.

"F(ab')2" consists of two light chains and two heavy chains comprising the constant region of a CH1 domain and a portion of CH2 domains so that disulfide bonds are formed between the two heavy chains. The F(ab')2 forming an antigen-binding molecule disclosed herein can be preferably produced as follows. A whole monoclonal antibody or such comprising a desired antigen-binding domain is partially digested with a protease such as pepsin; and Fc fragments are removed by adsorption onto a Protein A column. The protease is not particularly limited, as long as it can cleave the whole antibody in a selective manner to produce F(ab')2 under an appropriate setup enzyme reaction condition such as pH. Such proteases include, for example, pepsin and ficin.

Fc Domain

An Fc domain that forms an antigen-binding molecule disclosed herein can be preferably produced in the following manner. An antibody such as a monoclonal antibody is partially digested with a protease such as pepsin. Then, the resulting fragment is adsorbed onto a Protein A or Protein G column, and eluted with an appropriate elution buffer. The protease is not particularly limited, as long as it can cleave antibodies such as monoclonal antibodies under an appropriate setup enzyme reaction condition such as pH. Such proteases include, for example, pepsin and ficin.

The antigen-binding molecules described herein comprise an Fc domain with reduced Fcγ receptor-binding activity, which includes amino acids forming the Fc domain of IgG1, IgG2, IgG3, or IgG4.

Antibody isotype is determined according to the structure of the constant region. Constant regions of the isotypes IgG1, IgG2, IgG3, and IgG4 are called Cγ1, Cγ2, Cγ3, and Cγ4, respectively. The amino acid sequences of Fc domain polypeptides forming human Cγ1, Cγ2, Cγ3, and Cγ4 are exemplified in SEQ ID NO: 23, 24, 25, and 26, respectively. The relationship between amino acid residues forming each amino acid sequence and Kabat's EU numbering (herein also referred to as EU INDEX) are shown in FIG. 23.

The Fc domain refers to the region besides F(ab')2 which comprises two light chains and two heavy chains comprising a portion of the constant region that comprises a CH1 domain and a region between the CH1 and CH2 domains so that disulfide bonds are formed between the two heavy chains. The Fc domain forming an antigen-binding molecule disclosed herein can be preferably produced as follows. A monoclonal IgG1, IgG2, IgG3, or IgG4 antibody or the like is partially digested with a protease such as pepsin, followed by elution of the fraction adsorbed onto a Protein A column. The protease is not particularly limited, as long as it can cleave the whole antibody in a selective manner to produce F(ab')2 in an appropriate setup enzyme reaction condition such as pH. Such proteases include, for example, pepsin and ficin.

Fcγ Receptor

Fcγ receptor refers to a receptor capable of binding to the Fc domain of monoclonal IgG1, IgG2, IgG3, or IgG4 antibodies, and includes all members belonging to the family of proteins substantially encoded by an Fcγ receptor gene. In human, the family includes FcγRI (CD64) including isoforms FcγRIa, FcγRIb and FcγRIc; FcγRII (CD32) including isoforms FcγRIIa (including allotype H131 and R131), FcγRIIb (including FcγRIIb-1 and FcγRIIb-2), and FcγRIIc; and FcγRIII (CD16) including isoform FcγRIIIa (including allotype V158 and F158) and FcγRIIIb (including allotype FcγRIIIb-NA1 and FcγRIIIb-NA2); as well as all unidentified human FcγRs, FcγR isoforms, and allotypes thereof. However, Fcγ receptor is not limited to these examples. Without being limited thereto, FcγR includes those derived from humans, mice, rats, rabbits, and monkeys. FcγR may be derived from any organisms. Mouse FcγR includes, without being limited to, FcγRI (CD64), FcγRII (CD32), FcγRIII (CD16), and FcγRIII-2 (CD16-2), as well as all unidentified mouse FcγRs, FcγR isoforms, and allotypes thereof. Such preferred Fcγ receptors include, for example, human FcγRI (CD64), FcγRIIA (CD32), FcγRIIB (CD32), FcγRIIIA (CD16), and/or FcγRIIIB (CD16). The polynucleotide sequence and amino acid sequence of FcγRI are shown in SEQ ID NOs: 27 (NM_000566.3) and 28 (NP_000557.1), respectively; the polynucleotide sequence and amino acid sequence of FcγRIIA are shown in SEQ ID NOs: 29 (BC020823.1) and 30 (AAH20823.1), respectively; the polynucleotide sequence and amino acid sequence of FcγRIIB are shown in SEQ ID NOs: 31 (BC146678.1) and 32 (AAI46679.1), respectively; the polynucleotide sequence and amino acid sequence of FcγRIIIA are shown in SEQ ID NOs: 33 (BC033678.1) and 34 (AAH33678.1), respectively; and the polynucleotide sequence and amino acid sequence of FcγRIIIB are shown in SEQ ID NOs: 35 (BC128562.1) and 36 (AAI28563.1), respectively (RefSeq accession number is shown in each parentheses). Whether an Fcγ receptor has binding activity to the Fc domain of a monoclonal IgG1, IgG2, IgG3, or IgG4 antibody can be assessed by ALPHA screen (Amplified Luminescent Proximity Homogeneous Assay), surface plasmon resonance (SPR)-based BIACORE method, and others (Proc. Natl. Acad. Sci. USA (2006) 103(11), 4005-4010), in addition to the above-described FACS and ELISA formats.

Meanwhile, "Fc ligand" or "effector ligand" refers to a molecule and preferably a polypeptide that binds to an antibody Fc domain, forming an Fc/Fc ligand complex. The molecule may be derived from any organisms. The binding of an Fc ligand to Fc preferably induces one or more effector functions. Such Fc ligands include, but are not limited to, Fc receptors, FcγR, FcαR, FcεR, FcRn, C1q, and C3, mannan-binding lectin, mannose receptor, *Staphylococcus* Protein A, *Staphylococcus* Protein G, and viral FcγRs. The Fc ligands also include Fc receptor homologs (FcRH) (Davis et al., (2002) Immunological Reviews 190, 123-136), which are a family of Fc receptors homologous to FcγR. The Fc ligands also include unidentified molecules that bind to Fc.

Fcγ Receptor-Binding Activity

The impaired binding activity of Fc domain to any of the Fcγ receptors FcγI, FcγIIA, FcγIIB, FcγIIIA, and/or FcγIIIB can be assessed by using the above-described FACS and ELISA formats as well as ALPHA screen (Amplified Luminescent Proximity Homogeneous Assay) and surface plasmon resonance (SPR)-based BIACORE method (Proc. Natl. Acad. Sci. USA (2006) 103(11), 4005-4010).

ALPHA screen is performed by the ALPHA technology based on the principle described below using two types of beads: donor and acceptor beads. A luminescent signal is detected only when molecules linked to the donor beads interact biologically with molecules linked to the acceptor beads and when the two beads are located in close proximity. Excited by laser beam, the photosensitizer in a donor bead converts oxygen around the bead into excited singlet oxygen. When the singlet oxygen diffuses around the donor beads and reaches the acceptor beads located in close proximity, a chemiluminescent reaction within the acceptor beads is induced. This reaction ultimately results in light emission. If molecules linked to the donor beads do not interact with molecules linked to the acceptor beads, the singlet oxygen produced by donor beads do not reach the acceptor beads and chemiluminescent reaction does not occur.

For example, a biotin-labeled antigen-binding molecule is immobilized to the donor beads and glutathione S-transferase (GST)-tagged Fcγ receptor is immobilized to the acceptor beads. In the absence of an antigen-binding molecule comprising a competitive mutant Fc domain, Fcγ receptor interacts with an antigen-binding molecule comprising a wild-type Fc domain, inducing a signal of 520 to 620 nm as a result. The antigen-binding molecule having a non-tagged mutant Fc domain competes with the antigen-binding molecule comprising a wild-type Fc domain for the interaction with Fcγ receptor. The relative binding affinity can be determined by quantifying the reduction of fluorescence as a result of competition. Methods for biotinylating antigen-binding molecules such as antibodies using Sulfo-NHS-biotin or the like are known. Appropriate methods for adding the GST tag to an Fcγ receptor include methods that involve fusing polypeptides encoding Fcγ and GST in-frame, expressing the fused gene using cells introduced with a vector carrying the gene, and then purifying using a glutathione column. The induced signal can be preferably analyzed, for example, by fitting to a one-site competition model based on nonlinear regression analysis using software such as GRAPHPAD PRISM (GraphPad; San Diego).

One of the substances for observing their interaction is immobilized as a ligand onto the gold thin layer of a sensor chip. When light is shed on the rear surface of the sensor chip so that total reflection occurs at the interface between the gold thin layer and glass, the intensity of reflected light is partially reduced at a certain site (SPR signal). The other substance for observing their interaction is injected as an analyte onto the surface of the sensor chip. The mass of immobilized ligand molecule increases when the analyte binds to the ligand. This alters the refraction index of solvent on the surface of the sensor chip. The change in refraction index causes a positional shift of SPR signal (conversely, the dissociation shifts the signal back to the original position). In the Biacore system, the amount of shift described above (i.e., the change of mass on the sensor chip surface) is plotted on the vertical axis, and thus the change of mass over time is shown as measured data (sensorgram). Kinetic parameters (association rate constant (ka) and dissociation rate constant (kd)) are determined from the curve of sensorgram, and affinity (KD) is determined from the ratio between these two constants. Inhibition assay is preferably used in the BIACORE methods. Examples of such inhibition assay are described in Proc. Natl. Acad. Sci. USA (2006) 103(11), 4005-4010.

Herein, "Fcγ receptor-binding activity is reduced" means, for example, that based on the above-described analysis method the competitive activity of a test antigen-binding molecule is 50% or less, preferably 45% or less, 40% or less, 35% or less, 30% or less, 20% or less, or 15% or less, and particularly preferably 10% or less, 9% or less, 8% or less, 7% or less, 6% or less, 5% or less, 4% or less, 3% or less, 2% or less, or 1% or less than the competitive activity of a control antigen-binding molecule.

Antigen-binding molecules comprising the Fc domain of a monoclonal IgG1, IgG2, IgG3, or IgG4 antibody can be appropriately used as control antigen-binding molecules. The Fc domain structures are shown in SEQ ID NOs: 37 (A is added to the N terminus of RefSeq accession number AAC82527.1), 38 (A is added to the N terminus of RefSeq accession number AAB59393.1), 25 (A is added to the N terminus of RefSeq accession number CAA27268.1), and 39 (A is added to the N terminus of RefSeq accession number AAB59394.1). Furthermore, when an antigen-binding molecule comprising an Fc domain mutant of an antibody of a particular isotype is used as a test substance, the effect of the mutation of the mutant on the Fcγ receptor-binding activity is assessed using as a control an antigen-binding molecule comprising an Fc domain of the same isotype. As described above, antigen-binding molecules comprising an Fc domain mutant whose Fcγ receptor-binding activity has been judged to be reduced are appropriately prepared.

Such known mutants include, for example, mutants having a deletion of amino acids 231A-238S (EU numbering) (WO 2009/011941), as well as mutants C226S, C229S, P238S, (C220S) (J. Rheumatol (2007)34, 11); C226S and C229S (Hum. Antibod. Hybridomas (1990) 1(1), 47-54); C226S, C229S, E233P, L234V, and L235A (Blood (2007) 109, 1185-1192).

Specifically, the preferred antigen-binding molecules include those comprising an Fc domain with a substitution of the amino acid at position 220, 226, 229, 231, 232, 233, 234, 235, 236, 237, 238, 239, 240, 264, 265, 266, 267, 269, 270, 295, 296, 297, 298, 299, 300, 325, 327, 328, 329, 330, 331, or 332 (EU numbering) in the amino acids forming the Fc domain of an antibody of a particular isotype. The isotype of antibody from which the Fc domain originates is not particularly limited, and it is possible to use an appropriate Fc domain derived from a monoclonal IgG1, IgG2, IgG3, or IgG4 antibody. It is preferable to use Fc domains derived from IgG1 antibodies.

The preferred antigen-binding molecules include, for example, those comprising an Fc domain which has any one of the substitutions shown below, whose positions are specified according to EU numbering (each number represents the position of an amino acid residue in the EU numbering; and the one-letter amino acid symbol before the number represents the amino acid residue before substitution, while the one-letter amino acid symbol after the number represents the amino acid residue before the substitution) in the amino acids forming the Fc domain of IgG1 antibody:

(a) L234F, L235E, P331S;
(b) C226S, C229S, P238S;
(c) C226S, C229S;
(d) C226S, C229S, E233P, L234V, L235A;
(e) L234A, L235A or L235R, N297A;
(f) L235A or L235R, S239K, N297A as well as those having an Fc domain which has a deletion of the amino acid sequence at positions 231 to 238.

Furthermore, the preferred antigen-binding molecules also include those comprising an Fc domain that has any one of the substitutions shown below, whose positions are specified according to EU numbering in the amino acids forming the Fc domain of an IgG2 antibody:

(g) H268Q, V309L, A330S, and P331S;
(h) V234A;
(i) G237A;
(j) V234A and G237A;
(k) A235E and G237A;
(l) V234A, A235E, and G237A. Each number represents the position of an amino acid residue in EU numbering; and the one-letter amino acid symbol before the number represents the amino acid residue before substitution, while the one-letter amino acid symbol after the number represents the amino acid residue before the substitution.

Furthermore, the preferred antigen-binding molecules also include those comprising an Fc domain that has any one of the substitutions shown below, whose positions are specified according to EU numbering in the amino acids forming the Fc domain of an IgG3 antibody:

(m) F241A;
(n) D265A;
(o) V264A.

Each number represents the position of an amino acid residue in EU numbering; and the one-letter amino acid symbol before the number represents the amino acid residue before substitution, while the one-letter amino acid symbol after the number represents the amino acid residue before the substitution.

Furthermore, the preferred antigen-binding molecules also include those comprising an Fc domain that has any one of the substitutions shown below, whose positions are specified according to EU numbering in the amino acids forming the Fc domain of an IgG4 antibody:

(p) L235A, G237A, and E318A;
(q) L235E;
(r) F234A and L235A.

Each number represents the position of an amino acid residue in EU numbering; and the one-letter amino acid symbol before the number represents the amino acid residue before substitution, while the one-letter amino acid symbol after the number represents the amino acid residue before the substitution.

The other preferred antigen-binding molecules include, for example, those comprising an Fc domain in which any amino acid at position 233, 234, 235, 236, 237, 327, 330, or 331 (EU numbering) in the amino acids forming the Fc domain of an IgG1 antibody is substituted with an amino acid of the corresponding position in EU numbering in the corresponding IgG2 or IgG4.

The preferred antigen-binding molecules also include, for example, those comprising an Fc domain in which any one or more of the amino acids at positions 234, 235, and 297 (EU numbering) in the amino acids forming the Fc domain of an IgG1 antibody is substituted with other amino acids. The type of amino acid after substitution is not particularly limited; however, the antigen-binding molecules comprising an Fc domain in which any one or more of the amino acids at positions 234, 235, and 297 are substituted with alanine are particularly preferred.

The preferred antigen-binding molecules also include, for example, those comprising an Fc domain in which an amino acid at position 265 (EU numbering) in the amino acids forming the Fc domain of an IgG1 antibody is substituted with another amino acid. The type of amino acid after substitution is not particularly limited; however, antigen-binding molecules comprising an Fc domain in which an amino acid at position 265 is substituted with alanine are particularly preferred.

Multispecific Antigen-Binding Molecules

Examples of a preferred embodiment of the "multispecific antigen-binding molecule" of the present invention include multispecific antibodies. When an Fc region with reduced Fcγ receptor-binding activity is used as the multispecific antibody Fc region, an Fc region derived from the multispecific antibody may be used appropriately. Bispecific antibodies are particularly preferred as the multispecific antibodies of the present invention. In this case, a bispecific antibody is an antibody having two different specificities. IgG-type bispecific antibodies can be secreted from a hybrid hybridoma (quadroma) produced by fusing two types of hybridomas that produce IgG antibodies (Milstein et al., Nature (1983) 305, 537-540).

Furthermore, IgG-type bispecific antibodies are secreted by introducing the genes of L chains and H chains constituting the two types of IgGs of interest, i.e. a total of four genes, into cells, and co-expressing them. However, the number of combinations of H and L chains of IgG that can be produced by these methods is theoretically ten combinations. Accordingly, it is difficult to purify an IgG comprising the desired combination of H and L chains from ten types of IgGs. Furthermore, theoretically the amount of secretion of the IgG having the desired combination will decrease remarkably, and therefore large-scale culturing will be necessary, and production costs will increase further.

Therefore, techniques for promoting the association among H chains and between L and H chains having the desired combinations can be applied to the multispecific antigen-binding molecules of the present invention.

For example, techniques for suppressing undesired H-chain association by introducing electrostatic repulsion at the interface of the second constant region or the third constant region of the antibody H chain (CH2 or CH3) can be applied to multispecific antibody association (WO2006/106905).

In the technique of suppressing unintended H-chain association by introducing electrostatic repulsion at the interface of CH2 or CH3, examples of amino acid residues in contact at the interface of the other constant region of the H chain include regions corresponding to the residues at EU numbering positions 356, 439, 357, 370, 399, and 409 in the CH3 region.

More specifically, examples include an antibody comprising two types of H-chain CH3 regions, in which one to three pairs of amino acid residues in the first H-chain CH3 region, selected from the pairs of amino acid residues indicated in (1) to (3) below, carry the same type of charge: (1) amino acid residues comprised in the H chain CH3 region at EU numbering positions 356 and 439; (2) amino acid residues comprised in the H-chain CH3 region at EU numbering positions 357 and 370; and (3) amino acid residues comprised in the H-chain CH3 region at EU numbering positions 399 and 409.

Furthermore, the antibody may be an antibody in which pairs of the amino acid residues in the second H-chain CH3 region which is different from the first H-chain CH3 region mentioned above, are selected from the aforementioned pairs of amino acid residues of (1) to (3), wherein the one to three pairs of amino acid residues that correspond to the aforementioned pairs of amino acid residues of (1) to (3) carrying the same type of charges in the first H-chain CH3 region mentioned above carry opposite charges from the corresponding amino acid residues in the first H-chain CH3 region mentioned above.

Each of the amino acid residues indicated in (1) to (3) above come close to each other during association. Those skilled in the art can find out positions that correspond to the above-mentioned amino acid residues of (1) to (3) in a desired H-chain CH3 region or H-chain constant region by homology modeling and such using commercially available software, and amino acid residues of these positions can be appropriately subjected to modification.

In the antibodies mentioned above, "charged amino acid residues" are preferably selected, for example, from amino acid residues included in either one of the following groups:

(a) glutamic acid (E) and aspartic acid (D); and
(b) lysine (K), arginine (R), and histidine (H).

In the above-mentioned antibodies, the phrase "carrying the same charge" means, for example, that all of the two or more amino acid residues are selected from the amino acid residues included in either one of groups (a) and (b) mentioned above. The phrase "carrying opposite charges" means, for example, that when at least one of the amino acid residues among two or more amino acid residues is selected from the amino acid residues included in either one of groups (a) and (b) mentioned above, the remaining amino acid residues are selected from the amino acid residues included in the other group.

In a preferred embodiment, the antibodies mentioned above may have their first H-chain CH3 region and second H-chain CH3 region crosslinked by disulfide bonds.

In the present invention, amino acid residues subjected to modification are not limited to the above-mentioned amino acid residues of the antibody variable regions or the antibody constant regions. Those skilled in the art can identify the amino acid residues that form an interface in mutant polypeptides or heteromultimers by homology modeling and such using commercially available software; and amino acid residues of these positions can then be subjected to modification so as to regulate the association.

Other known techniques can also be used for the association of multispecific antibodies of the present invention. Fc region-containing polypeptides comprising different amino acids can be efficiently associated with each other by substituting an amino acid side chain present in one of the H-chain Fc regions of the antibody with a larger side chain (knob), and substituting an amino acid side chain present in the corresponding Fc region of the other H chain with a smaller side chain (hole) to allow placement of the knob within the hole (WO1996/027011; Ridgway J B et al., Protein Engineering (1996) 9, 617-621; Merchant A. M. et al. Nature Biotechnology (1998) 16, 677-681; and US20130336973).

In addition, other known techniques can also be used for formation of multispecific antibodies of the present invention. Association of polypeptides having different sequences can be induced efficiently by complementary association of CH3 using a strand-exchange engineered domain CH3 produced by changing part of one of the H-chain CH3s of an antibody to a corresponding IgA-derived sequence and introducing a corresponding IgA-derived sequence into the complementary portion of the other H-chain CH3 (Protein Engineering Design & Selection, 23; 195-202, 2010). This known technique can also be used to efficiently form multispecific antibodies of interest.

In addition, technologies for antibody production using association of antibody CH1 and CL and association of VH and VL as described in WO 2011/028952, WO2014/018572, and Nat Biotechnol. 2014 February; 32(2):191-8; technologies for producing bispecific antibodies using separately prepared monoclonal antibodies in combination (Fab Arm Exchange) as described in WO2008/119353 and WO2011/131746; technologies for regulating association between antibody heavy-chain CH3s as described in WO2012/058768 and WO2013/063702; technologies for producing bispecific antibodies composed of two types of light chains and one type of heavy chain as described in WO2012/023053; technologies for producing bispecific antibodies using two bacterial cell strains that individually express one of the chains of an antibody comprising a single H chain and a single L chain as described by Christoph et al. (Nature Biotechnology Vol. 31, p 753-758 (2013)); and such may be used for the formation of multispecific antibodies.

An embodiment of multispecific antibody formation includes methods for obtaining bispecific antibodies by mixing two types of monoclonal antibodies in the presence of a reducing agent to cleave the disulfide bonds in the core hinge region, followed by re-association for heterodimerization (FAE) as described above. Meanwhile, introduction of electrostatic interactions at the interacting interface of the CH3 region (WO2006/106905) can induce even more efficient heterodimerization during the re-association (WO2015/046467). In FAE using naturally-occurring IgG, re-association takes place randomly; and thus theoretically, bispecific antibodies can only be obtained at 50% efficiency; however, in this method, bispecific antibodies can be produced in high yield.

Alternatively, even when a multispecific antibody of interest cannot be formed efficiently, a multispecific antibody of the present invention can be obtained by separating and purifying the multispecific antibody of interest from the produced antibodies. For example, a method for enabling purification of two types of homomeric forms and the heteromeric antibody of interest by ion-exchange chromatography by imparting a difference in isoelectric points by introducing amino acid substitutions into the variable regions of the two types of H chains has been reported (WO2007114325). To date, as a method for purifying heteromeric antibodies, methods using Protein A to purify a heterodimeric antibody comprising a mouse IgG2a H chain that binds to Protein A and a rat IgG2b H chain that does not bind to Protein A have been reported (WO98050431 and WO95033844). Furthermore, a heterodimeric antibody can be purified efficiently on its own by using H chains comprising substitution of amino acid residues at EU numbering positions 435 and 436, which is the IgG-Protein A binding site, with Tyr, His, or such which are amino acids that yield a different Protein A affinity, or using H chains with a different protein A affinity obtained according to the method of Reference Example 9, to change the interaction of each of the H chains with Protein A, and then using a Protein A column.

Alternatively, a common L chain that can provide binding ability to a plurality of different H chains can be obtained and used as the common L chain of a multispecific antibody. Efficient expression of a multispecific IgG can be achieved by introducing the genes of such a common L chain and a plurality of different H chains into cells to express the IgG (Nature Biotechnology (1998) 16, 677-681). A method for selecting a common L chain that shows a strong binding ability to any of the different H chains can also be used when selecting the common H chain (WO 2004/065611).

Furthermore, an Fc region whose Fc region C-terminal heterogeneity has been improved can be appropriately used as an Fc region of the present invention. More specifically, the present invention provides Fc regions produced by deleting glycine at position 446 and lysine at position 447 as specified by EU numbering from the amino acid sequences of two polypeptides constituting an Fc region derived from IgG1, IgG2, IgG3, or IgG4.

A plurality, such as two or more, of these technologies can be used in combination. Furthermore, these technologies can be appropriately and separately applied to the two H chains to be associated. Furthermore, these techniques can be used in combination with the above-mentioned Fc region which has reduced binding activity to an Fcγ receptor. Furthermore, an antigen-binding molecule of the present invention may be a molecule produced separately so that it has the same amino acid sequence, based on the antigen-binding molecule subjected to the above-described modifications.

A non-limiting embodiment of the present invention provides anticancer agents comprising as an active ingredient a bispecific antibody of any one of (a) to (c) below that comprises an antibody variable region having glypican 3-binding activity and an antibody variable region having CD3-binding activity:

(a) a bispecific antibody in which CDR1, CDR2, and CDR3 comprised in the antibody variable region having glypican 3-binding activity are sequences having at least 80% identity to the amino acid sequences of the CDR1, CDR2, and CDR3 regions comprised in SEQ ID NO: 206, respectively; CDR1, CDR2, and CDR3 comprised in the antibody variable region having CD3-binding activity are sequences having at least 80% identity to the amino acid sequences of the CDR1, CDR2, and CDR3 regions comprised in SEQ ID NO: 168, respectively; and CDR1, CDR2, and CDR3 comprised in an antibody variable region of a common L chain are sequences having at least 80% identity to the amino acid sequences of the CDR1, CDR2, and CDR3 regions comprised in SEQ ID NO: 223, respectively;

(b) a bispecific antibody in which the antibody variable region having glypican 3-binding activity is a sequence having at least 80% identity to the amino acid sequence of SEQ ID NO: 206; the antibody variable region having CD3-binding activity is a sequence having at least 80% identity to the amino acid sequence of SEQ ID NO: 168; and an antibody variable region of a common L chain is a sequence having at least 80% identity to the amino acid sequence of SEQ ID NO: 223; and (c) a bispecific antibody which has an antibody H chain having glypican 3-binding activity and having at least 80% identity to the amino acid sequence of SEQ ID NO: 385; an antibody H chain having CD3-binding activity and having at least 80% identity to the amino acid sequence of SEQ ID NO: 402; and common L chains having at least 80% identity to the amino acid sequence of SEQ ID NO: 410.

In the bispecific antibody of any one of (a) to (c) above, the amino acid sequence identity of each specified heavy chain and light chain CDR1, CDR2, and CDR3, heavy chain variable region, light chain variable region, whole heavy chain, and whole light chain is preferably at least 75%, 80%, 81%, 82%, 83%, 84%, 85%, 86%, 87%, 88%, 89%, or 90%, or higher, and more preferably at least 91%, 92%, 93%, 94%, 95%, 96%, 97%, 98%, or 99% or higher.

Herein, sequence identity is calculated as the percentage of residues identical to those in the original amino acid sequence of heavy chain or light chain variable region determined after the sequences are aligned and gaps are appropriately introduced as necessary to maximize the sequence identity.

In the bispecific antibody of any one of (a) to (c) above, as long as the antibody has glypican 3- or CD3-binding activity, one or more amino acids may be substituted, deleted, added, and/or inserted in the amino acid sequences of heavy chain and light chain CDR1, CDR2, and CDR3, and heavy chain variable region, light chain variable region, whole heavy chain, and whole light chain. Methods well known to those skilled in the art for preparing such amino acid sequence in which one or more amino acids are substituted, deleted, added, and/or inserted include a method of introducing mutations into proteins. For example, those skilled in the art can prepare mutants that are functionally equivalent to the heavy chain or light chain variable region of the bispecific antibody which has the antibody H chain of SEQ ID NO: 385 having glypican 3-binding activity, the antibody H chain of SEQ ID NO: 402 having CD3-binding activity, and the antibody common L chains of SEQ ID NO: 410 by appropriately introducing mutations into the amino acid sequence of an antibody having glypican 3- or CD3-binding activity using site-directed mutagenesis (Hashimoto-Gotoh, T, Mizuno, T, Ogasahara, Y, and Nakagawa, M. (1995) An oligodeoxyribonucleotide-directed dual amber method for site-directed mutagenesis. Gene 152, 271-275; Zoller, M J, and Smith, M. (1983) Oligonucleotide-directed mutagenesis of DNA fragments cloned into M13 vectors. Methods Enzymol. 100, 468-500; Kramer, W, Drutsa, V, Jansen, H W, Kramer, B, Pflugfelder, M, and Fritz, H J (1984) The gapped duplex DNA approach to oligonucleotide-directed mutation construction. Nucleic Acids Res. 12, 9441-9456; Kramer W, and Fritz H J (1987) Oligonucleotide-directed construction of mutations via gapped duplex DNA Methods. Enzymol. 154, 350-367; Kunkel, T A (1985) Rapid and efficient site-specific mutagenesis without phenotypic selection. Proc Natl Acad Sci USA. 82, 488-492) or such. In the present invention, the phrase "functionally equivalent" means that the binding affinities for an antigen are equivalent, or alternatively, it means that the cytotoxic activities against glypican 3-expressing cells or tissues containing these cells are equivalent when it is used as a multispecific antigen-binding molecule. The binding affinity and cytotoxic activity can be measured based on the description herein. The details are described herein below.

The number of amino acids to be altered is not limited, and is, for example, 40 or less, 30 or less, 20 or less, preferably 18 or less, 16 or less, 15 or less, 12 or less, 10 or less, 9 or less, 8 or less, 7 or less, 6 or less, 5 or less, 4 or less, 3 or less, or 2 or less.

When an amino acid residue is altered, the amino acid is preferably mutated into a different amino acid(s) that conserves the properties of the amino acid side chain. Examples of amino acid side chain properties are: hydrophobic amino acids (A, I, L, M, F, P, W, Y, and V), hydrophilic amino acids (R, D, N, C, E, Q, G, H, K, S, and T), amino acids having aliphatic side chains (G, A, V, L, I, and P), amino acids having hydroxyl group-containing side chains (S, T, and Y), amino acids having sulfur-containing side chains (C and M), amino acids having carboxylic acid- and amide-containing side chains (D, N, E, and Q), amino acids having basic side chains (R, K, and H), and amino acids having aromatic side chains (H, F, Y, and W) (amino acids are represented by one-letter codes in parentheses). Amino acid substitutions within each of these groups are referred to as conservative substitutions. It is already known that a polypeptide having a modified amino acid sequence in which one or more amino acid residues in a given amino acid sequence are deleted, added, and/or substituted with other amino acids can retain the biological activity (Mark, D. F. et al., Proc. Natl. Acad. Sci. USA (1984)81:5662-6; Zoller, M. J. and Smith, M., Nucleic Acids Res. (1982)10:6487-500; Wang, A. et al., Science (1984) 224:1431-3; Dalbadie-McFarland, G. et al., Proc. Natl. Acad. Sci. USA (1982)79:6409-13).

Alternatively, an amino acid sequence having glypican 3- or CD3-binding activity that has a substitution, deletion, addition, and/or insertion of one or more amino acids in the amino acid sequence of the CDR region, heavy chain variable region, light chain variable region, whole heavy chain region, or whole light chain region can be obtained from nucleic acids that hybridize under stringent conditions with nucleic acids comprising the nucleotide sequence encoding the amino acid sequence of the CDR region, heavy chain variable region, light chain variable region, whole heavy chain region, or whole light chain region. Stringent hybridization conditions for isolating a nucleic acid that hybridizes under stringent conditions with a nucleic acid comprising a nucleotide sequence encoding the amino acid sequence of the CDR region, heavy chain variable region, light chain variable region, whole heavy chain region, or whole light chain region include, for example, the conditions of 6 M urea, 0.4% SDS, 0.5×SSC, and 37° C., or hybridization conditions with a stringency equivalent thereto. Isolation of nucleic acids with a much higher homology can be expected with more stringent conditions, for example, the conditions of 6 M urea, 0.4% SDS, 0.1×SSC, and 42° C. The washing conditions following the hybridization are, for example, washing with 0.5×SSC (1×SSC is 0.15 M NaCl and 0.015 M sodium citrate, pH 7.0) and 0.1% SDS at 60° C., more preferably washing with 0.2×SSC and 0.1% SDS at 60° C., even more preferably washing with 0.2×SSC and 0.1% SDS at 62° C., yet even more preferably washing with 0.2×SSC and 0.1% SDS at 65° C., and sill more preferably washing with 0.1×SSC and 0.1% SDS at 65° C. The washing time and the number of washes may be appropriately adjusted, for example, a 20-minute wash may be performed three times. The sequences of the isolated nucleic acids can be determined by known methods described below. The overall nucleotide sequence homology of the isolated nucleic acid is at least 50% or higher, preferably 70% or higher, 75% or higher, 80% or higher, 85% or higher, and more preferably 90% or higher (for example, 91%, 92%, 93%, 94%, 95%, 96%, 97%, 98%, 99%, or higher) sequence identity.

Instead of the above-described methods using hybridization techniques, gene amplification methods, for example, polymerase chain reaction (PCR), using primers synthesized based on the information of a nucleotide sequence encoding the amino acid sequence of the CDR region, heavy chain variable region, light chain variable region, whole heavy chain region, or whole light chain region can also be employed to isolate a nucleic acid that hybridizes under stringent conditions with a nucleic acid comprising a nucleotide sequence encoding the amino acid sequence of the region.

The identity of one nucleotide sequence or amino acid sequence to another can be determined using algorithm BLAST by Karlin and Altschul (Proc. Natl. Acad. Sci. USA (1993) 90:5873-7). Programs called BLASTN and BLASTX were developed based on this algorithm (Altschul et al., J. Mol. Biol. (1990) 215:403-10). Parameters for the analysis of nucleotide sequences by BLASTN based on BLAST include, for example, score=100 and wordlength=12. On the other hand, parameters for the analysis of amino acid sequences by BLASTX based on BLAST include, for example, score=50 and wordlength=3. Default parameters for each program are used when using the BLAST and Gapped BLAST programs. Specific techniques for such analyses are known (see the website of the National Center for Biotechnology Information (NCBI), Basic Local Alignment Search Tool (BLAST); http://www.ncbi.nlm.nih.gov).

A non-limiting embodiment of the present invention provides anticancer agents comprising as an active ingredient a bispecific antibody that has the two H chains and common L chains of the antibody of sample number 38 (Table 17) described in Examples and Reference Examples. A non-limiting embodiment of the present invention also provides anticancer agents comprising as an active ingredient a bispecific antibody that has the variable regions of the two H chains and common L chains of the antibody of sample number 38 and has glypican 3- and CD3-binding activities. A non-limiting embodiment of the present invention also provides anticancer agents comprising as an active ingredient a bispecific antibody that has the respective amino acid sequences of CDR1, CDR2, and CDR3 regions comprised in the two H chains and common L chains of the antibody of sample number 38 and has glypican 3- and CD3-binding activities.

A non-limiting embodiment of the present invention provides anticancer agents comprising as an active ingredient a bispecific antibody that has the antibody H chain of SEQ ID NO: 385 having glypican 3-binding activity, the antibody H chain of SEQ ID NO: 402 having CD3-binding activity, and the antibody common L chains of SEQ ID NO: 410.

A non-limiting embodiment of the present invention provides anticancer agents comprising as an active ingredient a bispecific antibody in which CDR1, CDR2, and CDR3 comprised in the antibody variable region having glypican 3-binding activity are the amino acid sequences of the CDR1, CDR2, and CDR3 regions comprised in SEQ ID NO: 206, respectively; CDR1, CDR2, and CDR3 comprised in the antibody variable region having CD3-binding activity are the amino acid sequences of the CDR1, CDR2, and CDR3 regions comprised in SEQ ID NO: 168, respectively; and CDR1, CDR2, and CDR3 comprised in the antibody variable region of the common L chain are the amino acid sequences of the CDR1, CDR2, and CDR3 regions comprised in SEQ ID NO: 223, respectively.

The amino acid sequences of CDR1, CDR2, and CDR3 comprised in the antibody variable region can be identified by methods known to those skilled in the art, and such methods are not particularly limited. The CDR1, CDR2, and CDR3 regions may be those based on numbering known to those skilled in the art, for example, Kabat, Chothia, or Contact numbering, or may be those based on other criteria. In a non-limiting embodiment of the present invention, the CDR1, CDR2, and CDR3 regions comprised in SEQ ID NO: 206 include the regions of amino acid sequences of positions 31 to 35 (SEQ ID NO: 456), positions 50 to 66 (SEQ ID NO: 457), and positions 99 to 104 (SEQ ID NO: 458), respectively (Kabat numbering); the regions of amino acid sequences of positions 26 to 32 (SEQ ID NO: 459), positions 52 to 57 (SEQ ID NO: 460), and positions 97 to 104 (SEQ ID NO: 461), respectively (Chothia numbering); and the regions of amino acid sequences of positions 30 to 35 (SEQ ID NO: 462), positions 47 to 59 (SEQ ID NO: 463), and positions 97 to 103 (SEQ ID NO: 464), respectively (Contact numbering); however, the CDR regions may be those based on other criteria.

In a non-limiting embodiment of the present invention, the CDR1, CDR2, and CDR3 regions comprised in SEQ ID NO: 168 include the regions of amino acid sequences of positions 31 to 35 (SEQ ID NO: 465), positions 50 to 68 (SEQ ID NO: 466), and positions 101 to 111 (SEQ ID NO: 467), respectively (Kabat numbering); the regions of amino acid sequences of positions 26 to 32 (SEQ ID NO: 468), positions 52 to 59 (SEQ ID NO: 469), and positions 99 to 111 (SEQ ID NO: 470), respectively (Chothia numbering); and the regions of amino acid sequences of positions 30 to 35 (SEQ ID NO: 471), positions 47 to 61 (SEQ ID NO: 472), and positions 99 to 110 (SEQ ID NO: 473), respectively (Contact numbering); however, the CDR regions may be those based on other criteria.

In a non-limiting embodiment of the present invention, the CDR1, CDR2, and CDR3 regions comprised in SEQ ID NO: 223 include the regions of amino acid sequences of positions 24 to 39 (SEQ ID NO: 474), positions 55 to 61 (SEQ ID NO: 475), and positions 94 to 102 (SEQ ID NO: 476), respectively (Kabat numbering and Chothia numbering); and the regions of amino acid sequences of positions 35 to 41 (SEQ ID NO: 477), positions 51 to 56 (SEQ ID NO: 478), and positions 94 to 101 (SEQ ID NO: 479), respectively (Contact numbering); however, the CDR regions may be those based on other criteria (see FIGS. 24-1, 24-2, and 25).

A non-limiting embodiment of the present invention provides anticancer agents comprising as an active ingredient a bispecific antibody in which the antibody variable region having glypican 3-binding activity is the amino acid sequence of SEQ ID NO: 206; the antibody variable region having CD3-binding activity is the amino acid sequence of SEQ ID NO: 168; and the antibody variable region of the common L chain is the amino acid sequence of SEQ ID NO: 223.

An appropriate multispecific antigen-binding molecule comprised in the anticancer agent or the pharmaceutical composition of the present invention comprises
(1) a domain comprising an antibody variable region having glypican 3-binding activity;
(2) a domain comprising an antibody variable region having T-cell receptor complex-binding activity; and (3) a domain comprising an Fc region with reduced Fcγ receptor-binding activity mentioned above, without limitation to its structure.

In the present invention, each of the above-mentioned domains can be linked directly by peptide bonds. For example, when using F(ab')$_2$ as the domain comprising an antibody variable region of (1) and (2), and these Fc regions as the domain comprising an Fc region with reduced Fcγ receptor-binding activity of (3), the polypeptides formed by linking the antibody variable region-containing domains of (1) and (2) and the Fc region-containing domain of (3) by peptide bonds will form an antibody structure. Such antibodies can be produced by purification from the above-mentioned hybridoma culture medium, and also by purifying antibodies from the culture medium of desired host cells that stably carry polynucleotides encoding the polypeptides constituting the antibody.

Examples of a preferred antibody H-chain variable region comprised in the anticancer agent or the pharmaceutical composition of the present invention contained in the antibody variable region having glypican 3-binding activity comprises the antibody H-chain variable regions of Table 1, or antibody H-chain variable regions having CDR sequences whose CDR1, CDR2, and CDR3 amino acid sequences are the same as the CDR1, CDR2, and CDR3 amino acid sequences contained in the H-chain variable regions of Table 1, or antibody H-chain variable regions which are functionally equivalent to the above-mentioned variable regions.

TABLE 1

| Sequence Name | SEQ ID NO: |
|---|---|
| H0000 | 40 |
| GCH003 | 170 |
| GCH005 | 171 |
| GCH006 | 172 |
| GCH007 | 173 |
| GCH008 | 174 |
| GCH010 | 175 |
| GCH012 | 176 |
| GCH013 | 177 |
| GCH014 | 178 |
| GCH015 | 179 |
| GCH016 | 180 |
| GCH019 | 181 |
| GCH022 | 182 |
| GCH023 | 183 |
| GCH025 | 184 |
| GCH026 | 185 |
| GCH027 | 186 |
| GCH029 | 187 |
| GCH032 | 188 |
| GCH034 | 189 |
| GCH035 | 190 |
| GCH039 | 191 |
| GCH040 | 192 |
| GCH042 | 193 |
| GCH043 | 194 |
| GCH045 | 195 |
| GCH053 | 196 |
| GCH054 | 197 |
| GCH055 | 198 |
| GCH056 | 199 |
| GCH057 | 200 |
| GCH059 | 201 |
| GCH060 | 202 |
| GCH061 | 203 |
| GCH062 | 204 |
| GCH064 | 205 |
| GCH065 | 206 |
| GCH066 | 207 |
| GCH067 | 208 |
| GCH068 | 209 |
| GCH073 | 210 |

TABLE 1-continued

| Sequence Name | SEQ ID NO: |
|---|---|
| GCH094 | 211 |
| GCH098 | 212 |
| GCH099 | 213 |
| GCH100 | 214 |
| H0610 | 215 |

Examples of a preferred antibody variable region having T-cell receptor complex-binding activity which is comprised in the anticancer agent or the pharmaceutical composition of the present invention include antibody variable regions having T-cell receptor-binding activity. Of the T-cell receptors, CD3 is preferred, and CD3ε is particularly preferred. Examples of an antibody H-chain variable region contained in such antibody variable regions include the antibody H-chain variable regions of Table 2, antibody H-chain variable regions having CDR sequences whose CDR1, CDR2, and CDR3 amino acid sequences are the same as the CDR1, CDR2, and CDR3 amino acid sequences contained in the antibody H-chain variable regions of Table 2, and antibody H-chain variable regions that are functionally equivalent to the above-mentioned variable regions.

TABLE 2

| Sequence Name | SEQ ID NO: |
|---|---|
| hCE115HA | 52 |
| CE115HA177 | 64 |
| CE115HA178 | 65 |
| CE115HA179 | 66 |
| CE115HA180 | 67 |
| hCE115HAa | 68 |
| TR01H006 | 69 |
| TR01H007 | 70 |
| TR01H008 | 71 |
| TR01H009 | 72 |
| TR01H010 | 73 |
| TR01H011 | 74 |
| TR01H012 | 75 |
| TR01H013 | 76 |
| TR01H014 | 77 |
| TR01H015 | 78 |
| TR01H016 | 79 |
| TR01H017 | 80 |
| TR01H018 | 81 |
| TR01H019 | 82 |
| TR01H020 | 83 |
| TR01H021 | 84 |
| TR01H022 | 85 |
| TR01H023 | 86 |
| TR01H024 | 87 |
| TR01H025 | 88 |
| TR01H026 | 89 |
| TR01H027 | 90 |
| TR01H028 | 91 |
| TR01H029 | 92 |
| TR01H030 | 93 |
| TR01H031 | 94 |
| TR01H032 | 95 |
| TR01H033 | 96 |
| TR01H034 | 97 |
| TR01H035 | 98 |
| TR01H036 | 99 |
| TR01H037 | 100 |
| TR01H038 | 101 |
| TR01H039 | 102 |
| TR01H040 | 103 |
| TR01H041 | 104 |
| TR01H042 | 105 |
| TR01H043 | 106 |
| TR01H044 | 107 |
| TR01H045 | 108 |
| TR01H046 | 109 |

TABLE 2-continued

| Sequence Name | SEQ ID NO: |
|---|---|
| TR01H047 | 110 |
| TR01H048 | 111 |
| TR01H049 | 112 |
| TR01H050 | 113 |
| TR01H051 | 114 |
| TR01H052 | 115 |
| TR01H053 | 116 |
| TR01H054 | 117 |
| TR01H055 | 118 |
| TR01H056 | 119 |
| TR01H057 | 120 |
| TR01H058 | 121 |
| TR01H061 | 122 |
| TR01H062 | 123 |
| TR01H063 | 124 |
| TR01H064 | 125 |
| TR01H065 | 126 |
| TR01H066 | 127 |
| TR01H067 | 128 |
| TR01H068 | 129 |
| TR01H069 | 130 |
| TR01H070 | 131 |
| TR01H071 | 132 |
| TR01H072 | 133 |
| TR01H073 | 134 |
| TR01H074 | 135 |
| TR01H075 | 136 |
| TR01H076 | 137 |
| TR01H077 | 138 |
| TR01H079 | 139 |
| TR01H080 | 140 |
| TR01H081 | 141 |
| TR01H082 | 142 |
| TR01H083 | 143 |
| TR01H084 | 144 |
| TR01H090 | 145 |
| TR01H091 | 146 |
| TR01H092 | 147 |
| TR01H093 | 148 |
| TR01H094 | 149 |
| TR01H095 | 150 |
| TR01H096 | 151 |
| TR01H097 | 152 |
| TR01H098 | 153 |
| TR01H099 | 154 |
| TR01H100 | 155 |
| TR01H101 | 156 |
| TR01H102 | 157 |
| TR01H103 | 158 |
| TR01H104 | 159 |
| TR01H105 | 160 |
| TR01H106 | 161 |
| TR01H107 | 162 |
| TR01H108 | 163 |
| TR01H109 | 164 |
| TR01H110 | 165 |
| TR01H111 | 166 |
| TR01H112 | 167 |
| TR01H113 | 168 |
| TR01H114 | 169 |
| TR01H001 | 420 |
| TR01H002 | 421 |
| TR01H003 | 422 |
| TR01H004 | 423 |
| rCE115H | 424 |
| CE115HA121 | 425 |
| CE115HA122 | 426 |
| CE115HA124 | 427 |
| CE115HA192 | 428 |
| CE115HA236 | 429 |
| CE115HA251 | 430 |
| CE115HA252 | 431 |

Figure 1B:
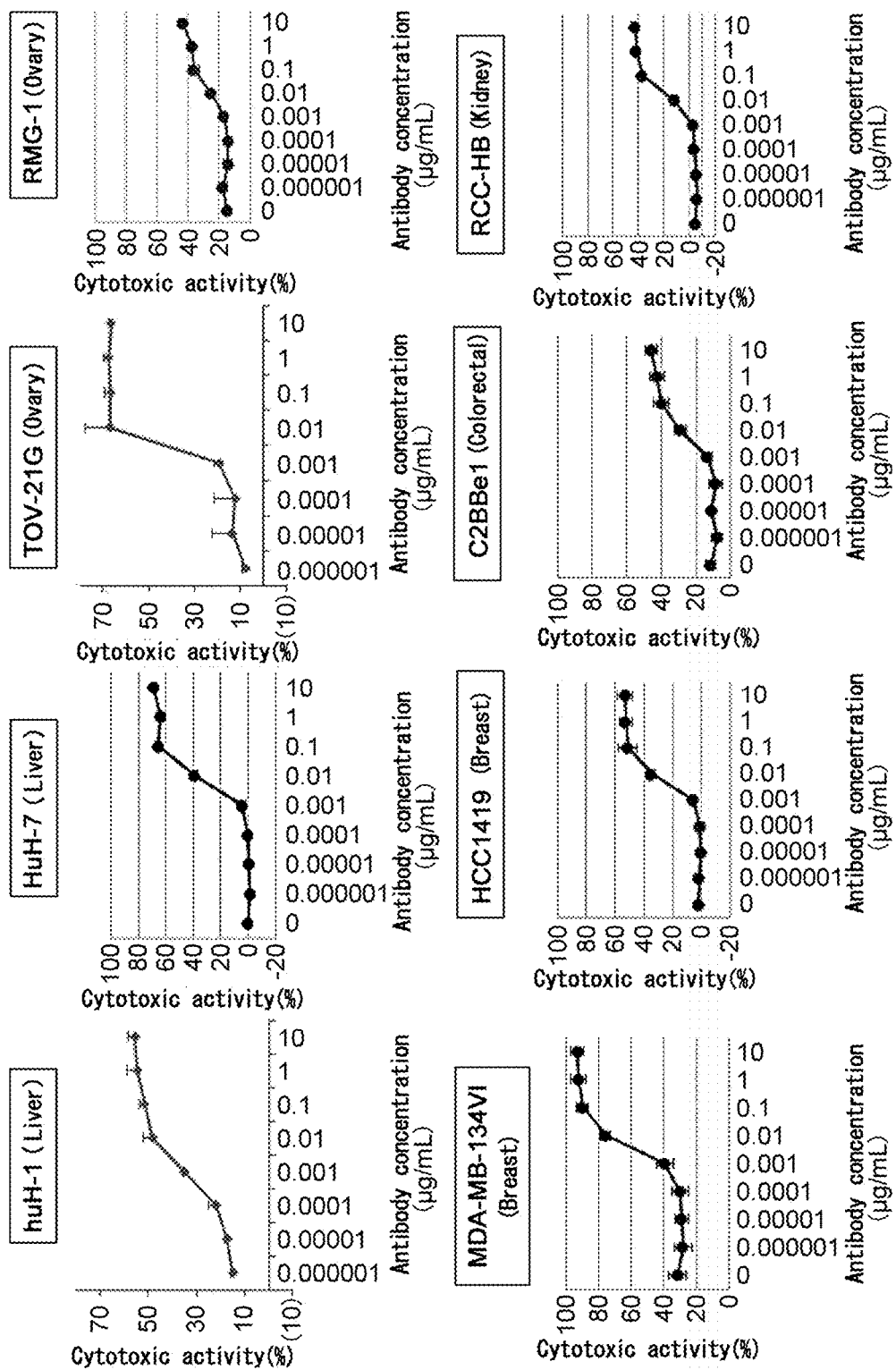
FIG. 1B is graphs showing the cytotoxic activity of antibody-38 when cell lines derived from various cancer types are used as target cells (a continuation of FIG. 1A).
Figure 1C:
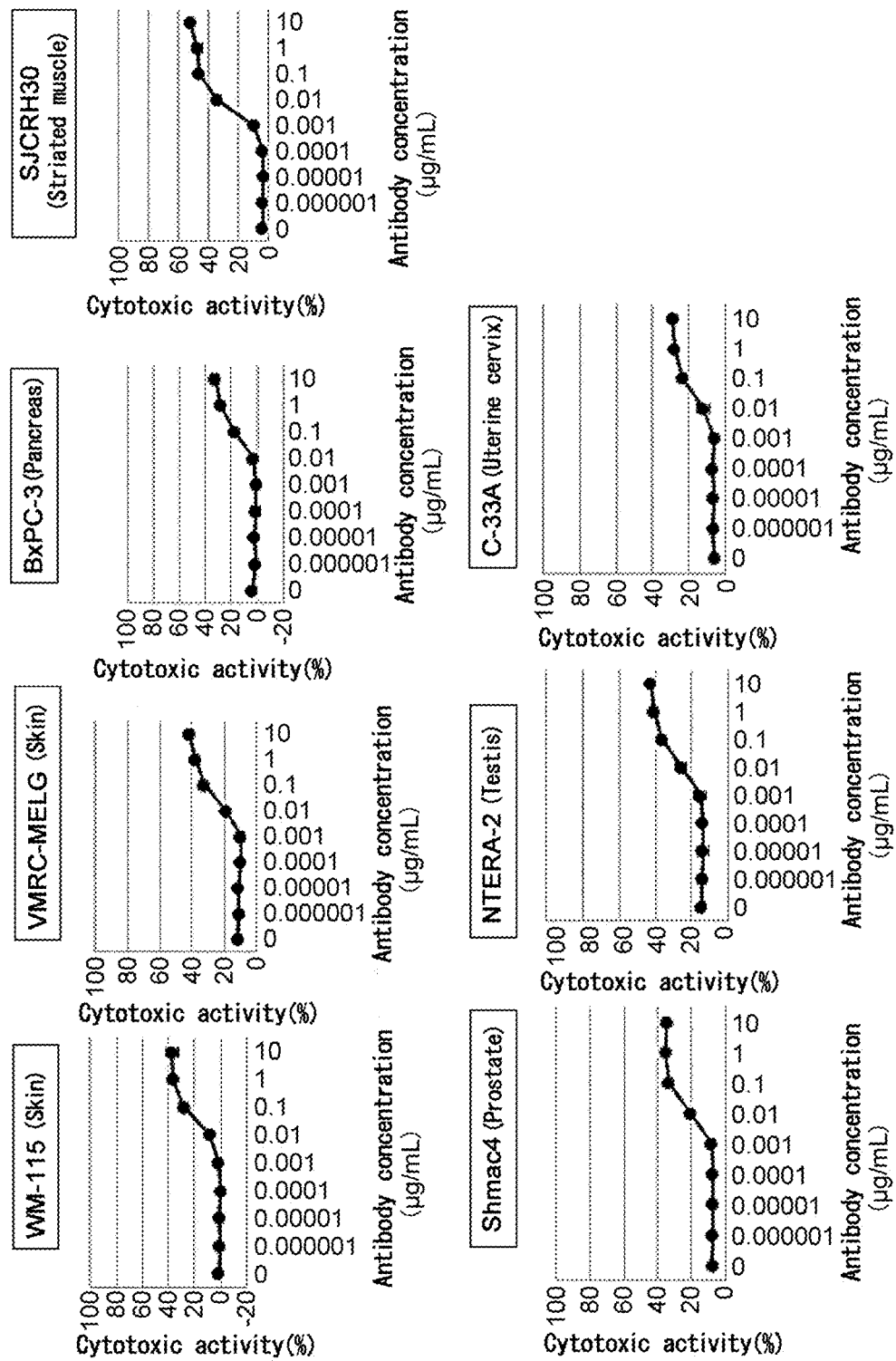
FIG. 1C is graphs showing the cytotoxic activity of antibody-38 when cell lines derived from various cancer types are used as target cells (a continuation of FIG. 1B).
Figure 2:
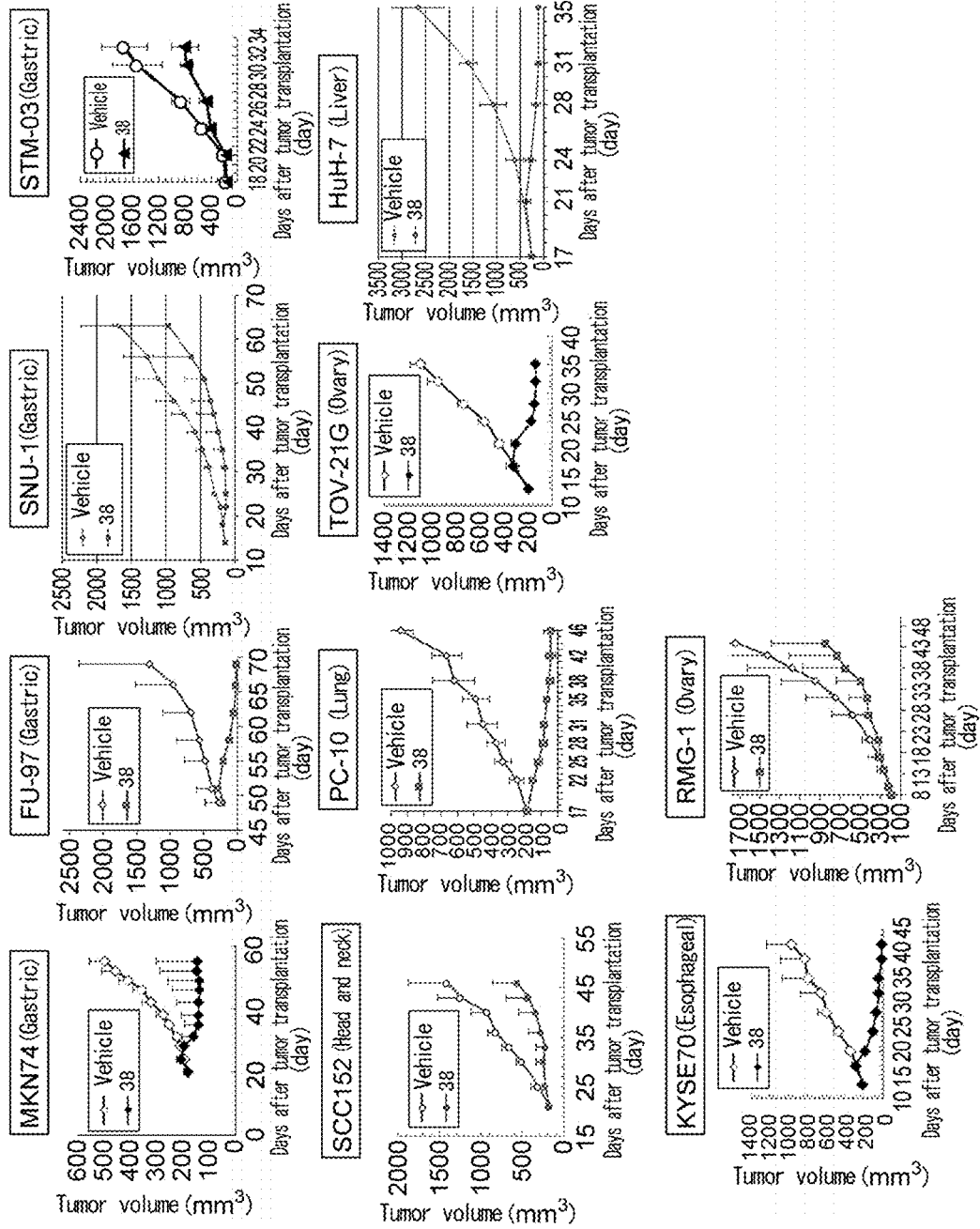
FIG. 2 is graphs showing the anti-tumor activity of antibody-38 against xenograft tumors derived from various cancer types in a human T cell transplantation model.
Figure 24A:
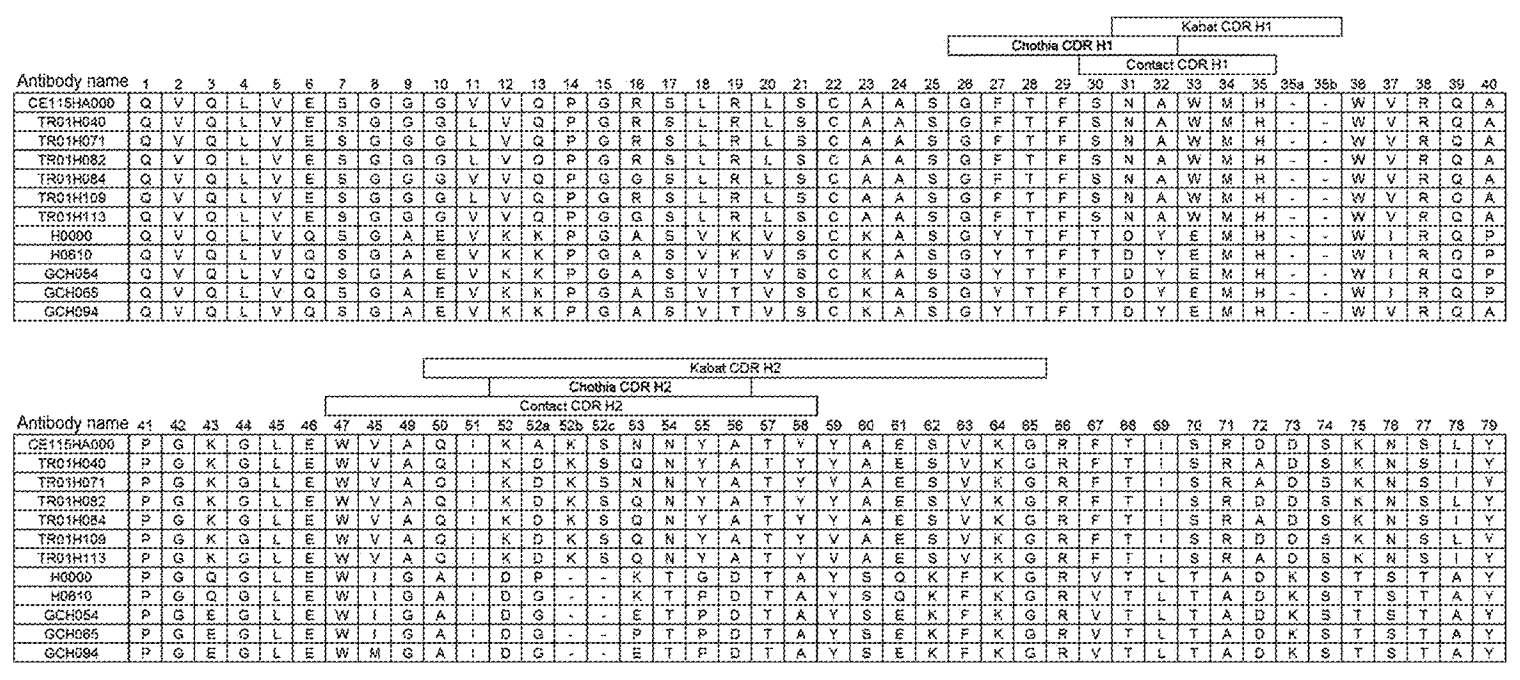
Figure 24B:
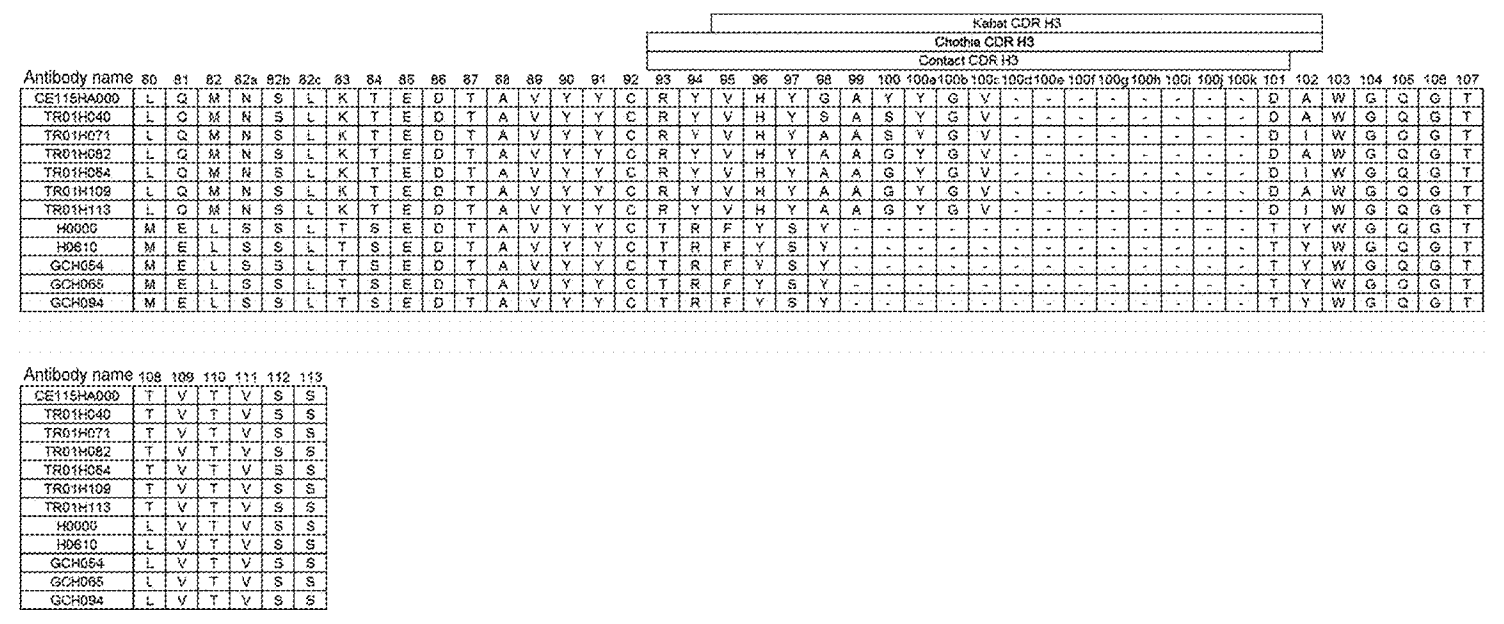

The relationship between the CDR regions of the amino acid residues constituting the antibody H chain amino acid sequence and Kabat numbering is as shown in FIG. 24 (FIGS. 24-1 and 24-2).

For the antibody L-chain variable regions contained in the antibody variable region having glypican 3-binding activity and the antibody variable region having T-cell receptor complex-binding activity which are comprised in the anti-cancer agent or the pharmaceutical composition of the present invention, it is preferable to obtain a common L chain that may provide a binding activity to the H chain having glypican 3-binding activity and a binding activity to the H chain having T-cell receptor complex, and to use this as the common L-chain variable region of the multispecific antigen-binding molecule.

Examples of the common L-chain variable region to be used in the present invention include the L-chain variable regions of Table 3, antibody L-chain variable regions having CDR sequences whose CDR1, CDR2, and CDR3 amino acid sequences are the same as the CDR1, CDR2, and CDR3 amino acid sequences contained in the antibody L-chain variable regions of Table 3, and antibody L-chain variable regions that are functionally equivalent to the above-mentioned variable regions.

TABLE 3

| Sequence Name | SEQ ID NO: |
|---|---|
| L0000 | 53 |
| L0002 | 217 |
| L0003 | 218 |
| L0006 | 219 |
| L0007 | 220 |
| L0008 | 221 |
| L0009 | 222 |
| L0011 | 223 |
| L0012 | 224 |
| L0013 | 225 |
| L0014 | 226 |
| L0015 | 227 |
| L0016 | 228 |
| L0032 | 229 |
| L0038 | 230 |
| L0039 | 231 |
| L0041 | 232 |
| L0042 | 233 |
| L0043 | 234 |
| L0044 | 235 |
| L0045 | 236 |
| L0046 | 237 |
| L0047 | 238 |
| L0062 | 239 |
| L0063 | 240 |
| L0064 | 241 |
| L0065 | 242 |
| L0066 | 243 |
| L0069 | 244 |
| L0075 | 245 |
| L0079 | 246 |
| L0082 | 247 |
| L0085 | 248 |
| L0089 | 249 |
| L0090 | 250 |
| L0091 | 251 |
| L0093 | 252 |
| L0104 | 253 |
| L0106 | 254 |
| L0107 | 255 |
| L0109 | 256 |
| L0113 | 257 |
| L0115 | 258 |
| L0117 | 259 |
| L0120 | 260 |
| L0122 | 261 |
| L0123 | 262 |
| L0124 | 263 |
| L0125 | 264 |
| L0126 | 265 |
| L0127 | 266 |
| L0129 | 267 |

TABLE 3-continued

| Sequence Name | SEQ ID NO: |
|---|---|
| L0132 | 268 |
| L0134 | 269 |
| L0136 | 270 |
| L0137 | 271 |
| L0138 | 272 |
| L0139 | 273 |
| L0140 | 274 |
| L0141 | 275 |
| L0143 | 276 |
| L0144 | 277 |
| L0145 | 278 |
| L0147 | 279 |
| L0148 | 280 |
| L0149 | 281 |
| L0151 | 282 |
| L0152 | 283 |
| L0154 | 284 |
| L0155 | 285 |
| L0157 | 286 |
| L0160 | 287 |
| L0161 | 288 |
| L0163 | 289 |
| L0167 | 290 |
| L0168 | 291 |
| L0173 | 292 |
| L0175 | 293 |
| L0180 | 294 |
| L0181 | 295 |
| L0186 | 296 |
| L0187 | 297 |
| L0200 | 298 |
| L0201 | 299 |
| L0202 | 300 |
| L0203 | 301 |
| L0204 | 302 |
| L0205 | 303 |
| L0206 | 304 |
| L0207 | 305 |
| L0208 | 306 |
| L0209 | 307 |
| L0210 | 308 |
| L0211 | 309 |
| L0212 | 310 |
| L0213 | 311 |
| L0214 | 312 |
| L0215 | 313 |
| L0216 | 314 |
| L0217 | 315 |
| L0218 | 316 |
| L0219 | 317 |
| L0220 | 318 |
| L0222 | 319 |
| L0223 | 320 |
| L0224 | 321 |
| L0226 | 322 |
| L0227 | 323 |
| L0228 | 324 |
| L0229 | 325 |
| L0230 | 326 |
| L0231 | 327 |
| L0232 | 328 |
| L0233 | 329 |
| L0234 | 330 |
| L0235 | 331 |
| L0236 | 332 |
| L0237 | 333 |
| L0238 | 334 |
| L0239 | 335 |
| L0240 | 336 |
| L0241 | 337 |
| L0242 | 338 |
| L0243 | 339 |
| L0246 | 340 |
| L0247 | 341 |
| L0248 | 342 |
| L0249 | 343 |
| L0250 | 344 |
| L0258 | 345 |
| L0259 | 346 |
| L0260 | 347 |
| L0261 | 348 |
| L0262 | 349 |
| L0263 | 350 |
| L0264 | 351 |
| L0265 | 352 |
| L0266 | 353 |
| L0267 | 354 |
| L0268 | 355 |
| L0269 | 356 |
| L0270 | 357 |
| L0271 | 358 |
| L0272 | 359 |

Figure 25:
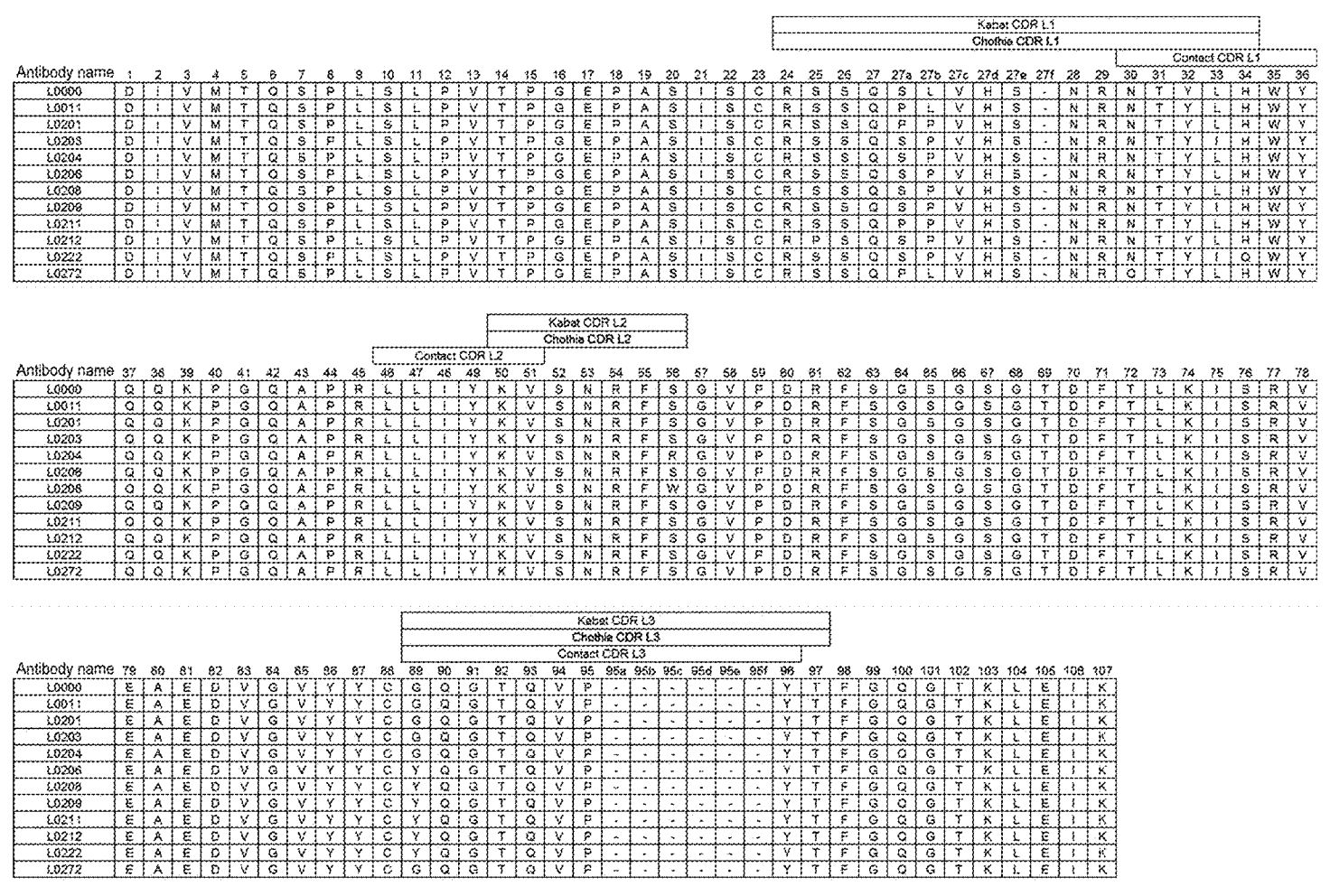

The relationship between the CDR regions of the amino acid residues constituting the antibody L-chain amino acid sequence and Kabat numbering is as shown in FIG. 25.

In the present invention, the phrase "functionally equivalent" means that the binding affinities for an antigen are equivalent, or alternatively, it means that the cytotoxic activities against glypican 3-expressing cells or tissues containing these cells are equivalent when it is used as a multispecific antigen-binding molecule. The binding affinity and cytotoxic activity can be measured based on the description herein. The cells used for measurement of cytotoxic activity may be the desired GPC3-expressing cells or a desired tissue containing these cells, and for example, PC-10 or NCI-H446 which are GPC3-expressing human cancer cell lines can be used. Regarding the antibody constant regions, the phrase may mean that the decreases in Fcγ receptor-binding activity are equivalent.

For example, an antibody H-chain variable region functionally equivalent to the antibody H chain variable region described herein (i.e., the original H chain variable region) means that this region has the same binding affinity when it is combined with the antibody L-chain variable region described herein which forms a pair with the original H chain, or alternatively that the region has the same cytotoxic activity towards glypican 3-expressing cells or a tissue containing these cells when used for a multispecific antigen-binding molecule. Furthermore, an antibody L-chain variable region functionally equivalent to the antibody L-chain variable region described herein (i.e., the original L-chain variable region) means that this region has the same binding affinity when it is combined with the antibody H-chain variable region described herein which forms a pair with the original L chain, or alternatively that the region has the same cytotoxic activity towards glypican 3-expressing cells or a tissue containing these cells when used for a multispecific antigen-binding molecule.

The term "equivalent" does not necessarily have to mean the same degree of activity, and the activity may be enhanced. Specifically, for antigen-binding affinity, examples include the case where the value (KD value/parent KD value) obtained by comparison to the binding affinity of the antibody variable region serving as the control (parent KD value) is 1.5 or less. The value of KD value/parent KD value is preferably 1.3 or less, more preferably 1.2 or less, 1.1 or less, 1.0 or less, 0.9 or less, 0.8 or less, 0.7 or less, 0.6 or less, or 0.5 or less. While there is no lower limit, examples include $10^{-1}$, $10^{-2}$, $10^{-3}$, $10^{-4}$, $10^{-5}$, or $10^{-6}$. More specifically, in the present invention, the value of KD value/parent KD value is preferably $10^{-6}$ to $1.5 \times 10^{-0}$, more preferably $10^{-6}$ to $10^{-1}$, even more preferably $10^{-6}$ to $10^{-2}$, and yet even more preferably $10^{-6}$ to $10^{-3}$. For cytotoxic activity, examples include the case where the value (cell proliferation inhibition rate/parent cell proliferation inhibition rate) obtained by comparison to the cell proliferation inhibition rate of the multispecific antigen-binding molecule serving as the control (parent cell proliferation inhibition rate) is 0.7 or more. The concentration of the added multispecific antigen-binding molecule can be determined appropriately, but is preferably, for example, 0.01 nM, 0.05 nM, 0.1 nM, 0.5 nM, or 1 nM; and preferably, measurements are taken at 0.05 nM or 0.1 nM. The value for cell proliferation inhibition rate/parent cell proliferation inhibition rate is preferably 0.8 or higher, more preferably 0.9 or higher, 1.0 or higher, 1.2 or higher, 1.5 or higher, 2 or higher, 3 or higher, 5 or higher, 10 or higher, or 20 or higher. While there is no upper limit, the value may be 10, $10^2$, $10^3$, $10^4$, $10^5$, or $10^6$.

Furthermore, for cytotoxic activity, examples include the case where the value (concentration for 50% inhibition of cell proliferation/parent concentration for 50% inhibition of cell proliferation) obtained by comparison to the concentration of the original multispecific antigen-binding molecule for 50% inhibition of cell proliferation (parent concentration for 50% inhibition of cell proliferation) is 1.5 or less. Concentration for 50% growth inhibition refers to the concentration of the multispecific antigen-binding molecule necessary for reducing the cell proliferation rate to one half compared to when the multispecific antigen-binding molecule is not added. The value of "concentration for 50% inhibition of cell proliferation/parent concentration for 50% inhibition of cell proliferation" is preferably 1.3 or less, more preferably 1.2 or less, 1.1 or less, 1.0 or less, 0.9 or less, 0.8 or less, 0.7 or less, 0.6 or less, or 0.5 or less. While there is no lower limit, the value may be, for example, $10^{-1}$, $10^{-2}$, $10^{-3}$, $10^{-4}$, $10^{-5}$ or $10^{-6}$. Specifically, the value is preferably $10^{-6}$ to $1.5 \times 10^{-0}$, more preferably $10^{-6}$ to $10^{-1}$, even more preferably $10^{-6}$ to $10^{-2}$, and yet even more preferably $10^{-6}$ to $10^{-3}$.

Regarding the domain comprising an antibody variable region having GPC3-binding activity, the KD value towards GPC3 (for example, human GPC3) may be, for example, $5 \times 10^{-9}$ M or less, preferably $4 \times 10^{-9}$ M or less, such as $3 \times 10^{-9}$ M or less, $2 \times 10^{-9}$ M or less, $1 \times 10^{-9}$ M or less, $8 \times 10^{-10}$ M or less, $5 \times 10^{-10}$ M or less, $4 \times 10^{-10}$ M or less, $3 \times 10^{-10}$ M or less, $2 \times 10^{-10}$ M or less, $1 \times 10^{-10}$ M or less, $8 \times 10^{-11}$ M or less, $5 \times 10^{-11}$ M or less, $4 \times 10^{-11}$ M or less, $3 \times 10^{-11}$ M or less, $2 \times 10^{-11}$ M or less, $1 \times 10^{-10}$ M or less, $8 \times 10^{-12}$ M or less, $5 \times 10^{-12}$ M or less, $4 \times 10^{-12}$ M or less, $3 \times 10^{-12}$ M or less, $2 \times 10^{-12}$ M or less, $1 \times 10^{-12}$ M or less, $8 \times 10^{-13}$ M or less, $5 \times 10^{-13}$ M or less, $4 \times 10^{-13}$ M or less, $3 \times 10^{-13}$ M or less, $2 \times 10^{-13}$ M or less, or $1 \times 10^{-13}$ M or less.

Regarding the domain comprising an antibody variable region having T-cell receptor complex-binding activity, the KD value towards a human T-cell receptor complex such as a human T cell receptor, or more specifically for example human CD3ε may be, for example, $2 \times 10^{-7}$ M or less, preferably $1.5 \times 10^{-7}$ M or less, such as $1.4 \times 10^{-7}$ M or less, $1.3 \times 10^{-7}$ M or less, $1.2 \times 10^{-7}$ M or less, $1 \times 10^{-7}$ M or less, $3 \times 10^{-8}$ M or less, $2 \times 10^{-8}$ M or less, $1 \times 10^{-8}$ M or less, $8 \times 10^{-9}$ M or less, $5 \times 10^{-9}$ M or less, $4 \times 10^{-9}$ M or less, $3 \times 10^{-9}$ M or less, $2 \times 10^{-9}$ M or less, $1 \times 10^{-9}$ M or less, $8 \times 10^{-10}$ M or less, $5 \times 10^{-10}$ M or less, $4 \times 10^{-10}$ M or less, $3 \times 10^{-10}$ M or less, $2 \times 10^{-10}$ M or less, $1 \times 10^{-10}$ M or less, $8 \times 10^{-11}$ M or less, $3 \times 10^{-11}$ M or less, $2 \times 10^{-11}$ M or less, $1 \times 10^{-11}$ M or less, $8 \times 10^{-12}$ M or less, $5 \times 10^{-12}$ M or less, $4 \times 10^{-12}$ M or less, $3 \times 10^{-12}$ M or less, $2 \times 10^{-12}$ M or less, or $1 \times 10^{-12}$ M or less.

The multispecific antigen-binding molecules of the present invention preferably have KD values toward human GPC3 and human T-cell receptor complex (for example, human CD3ε chain) that are $5 \times 10^{-9}$ M or less and $2 \times 10^{-7}$ M or less, respectively, and more preferably $1 \times 10^{-9}$ M or less and $5 \times 10^{-8}$ M or less, respectively.

In the present invention, antibody variable regions that are "functionally equivalent" are not particularly limited as long as they are antibody H-chain and/or antibody L-chain variable regions that satisfy the above-described conditions. Examples of such antibody variable regions include regions produced by introducing substitution, deletion, addition, and/or insertion of one or more amino acids (for example, 1, 2, 3, 4, 5, or 10 amino acids) into the amino acid sequences of the variable regions of Tables 1 to 3 mentioned above. A method well known to those skilled in the art for introducing one or more amino-acid substitutions, deletions, additions, and/or insertions into an amino acid sequence is a method of introducing mutations into proteins. For example, those skilled in the art can prepare variable regions that are functionally equivalent to the antibody variable regions having the above-mentioned functions by appropriately introducing mutations into amino acid sequences using methods such as site-directed mutagenesis (Hashimoto-Gotoh, T, Mizuno, T, Ogasahara, Y., and Nakagawa, M. (1995) An oligodeoxyribonucleotide-directed dual amber method for site-directed mutagenesis. Gene 152, 271-275; Zoller, M. J., and Smith, M. (1983) Oligonucleotide-directed mutagenesis of DNA fragments cloned into M13 vectors. Methods Enzymol. 100, 468-500; Kramer, W., Drutsa, V., Jansen, H. W., Kramer, B., Pflugfelder, M., and Fritz, H. J. (1984). The gapped duplex DNA approach to oligonucleotide-directed mutation construction. Nucleic Acids Res. 12, 9441-9456; Kramer, W., and Fritz, H. J. (1987) Oligonucleotide-directed construction of mutations via gapped duplex DNA Methods. Enzymol. 154, 350-367; and Kunkel, T. A. (1985) Rapid and efficient site-specific mutagenesis without phenotypic selection. Proc Natl Acad. Sci. USA. 82, 488-492).

When an amino acid residue is altered, the amino acid is preferably mutated into a different amino acid(s) that conserves the properties of the amino acid side-chain as mentioned above. Examples of amino-acid side chain properties are: hydrophobic amino acids (A, I, L, M, F, P, W, Y, and V), hydrophilic amino acids (R, D, N, C, E, Q, G, H, K, S, and T), amino acids containing aliphatic side chains (G, A, V, L, I, and P), amino acids containing hydroxyl group-containing side chains (S, T, and Y), amino acids containing sulfur atom-containing side chains (C and M), amino acids containing carboxylic acid- and amide-containing side chains (D, N, E, and Q), amino acids containing basic side chains (R, K, and H), and amino acids containing aromatic side chains (H, F, Y, and W) (amino acids are represented by one-letter codes in parentheses). Amino acid substitutions within each of these groups are called conservative substitutions. It is already known that a polypeptide containing a modified amino acid sequence in which one or more amino acid residues in a given amino acid sequence are deleted, added, and/or substituted with other amino acids can retain the original biological activity (Mark, D. F. et al., Proc. Natl. Acad. Sci. USA; (1984) 81: 5662-6; Zoller, M. J. and Smith, M., Nucleic Acids Res. (1982) 10: 6487-500; Wang, A. et al., Science (1984) 224: 1431-3; Dalbadie-McFarland, G. et al., Proc. Natl. Acad. Sci. USA (1982) 79: 6409-13). Variable regions of the present invention containing such amino acid modifications have an amino acid sequence identity of at least 70%, more preferably at least 75%, even more preferably at least 80%, still more preferably at least 85%, yet more preferably at least 90%, and most preferably at least 95%, with the amino acid sequence of the CDR sequences, FR sequences, or whole variable regions of the variable region prior to modification. Herein, sequence identity is defined as the percentage of residues identical to those in the original amino acid sequence of the H-chain variable region or L-chain variable region determined after the sequences are aligned, and gaps are appropriately introduced to maximize the sequence identity as necessary. The identity of amino acid sequences can be determined by the method described below.

Furthermore, a "functionally equivalent antibody variable region" can be obtained, for example, from nucleic acids that hybridize under stringent conditions with nucleic acids comprising a nucleotide sequence encoding the amino acid sequence of a variable region in Tables 1 to 3 mentioned above. Stringent hybridization conditions for isolating a nucleic acid that hybridizes under stringent conditions with a nucleic acid comprising a nucleotide sequence encoding the amino acid sequence of a variable region include, for example, the conditions of 6 M urea, 0.4% SDS, 0.5×SSC, and 37° C., or hybridization conditions with a stringency equivalent thereto as mentioned above. Isolation of nucleic acids with a much higher homology can be expected with more stringent conditions, for example, the conditions of 6 M urea, 0.4% SDS, 0.1×SSC, and 42° C. The washing conditions following the hybridization are, for example, washing using 0.5×SSC (1×SSC is 0.15 M NaCl and 0.015 M sodium citrate at pH7.0) and 0.1% SDS at 60° C., more preferably washing using 0.2×SSC and 0.1% SDS at 60° C., even more preferably washing using 0.2×SSC and 0.1% SDS at 62° C., yet even more preferably washing using 0.2×SSC and 0.1% SDS at 65° C., and still more preferably washing using 0.1×SSC and 0.1% SDS at 65° C. as mentioned above. The sequences of the isolated nucleic acids can be determined by the known methods described below. The overall nucleotide sequence homology of the isolated nucleic acid is at least 50% or higher, preferably 70% or higher, and more preferably 90% or higher (for example, 95%, 96%, 97%, 98%, 99%, or higher) sequence identity.

Nucleic acids that hybridize under stringent conditions to a nucleic acid comprising a nucleotide sequence encoding the amino acid sequence of a variable region can also be isolated by using, instead of the above-described methods using hybridization techniques, gene amplification methods such as polymerase chain reaction (PCR) that uses primers synthesized based on information of the nucleotide sequence encoding the variable-region amino acid sequence.

The identity of one nucleotide sequence or amino acid sequence to another can be determined using the algorithm BLAST, by Karlin and Altschul (Proc. Natl. Acad. Sci. USA (1993) 90: 5873-7) as mentioned above. Programs called BLASTN and BLASTX were developed based on this algorithm (Altschul et al., J. Mol. Biol. (1990) 215: 403-10). To analyze nucleotide sequences according to BLASTN based on BLAST, the parameters are set, for example, as score=100 and wordlength=12. On the other hand, parameters used for the analysis of amino acid sequences by BLASTX based on BLAST include, for example, score=50 and wordlength=3. Default parameters for each program are used when using the BLAST and Gapped BLAST programs. Specific techniques for such analyses are known in the art (see the website of the National Center for Biotechnology Information (NCBI), Basic Local Alignment Search Tool (BLAST); http://www.ncbi.nlm.nih.gov).

The combination of the antibody variable region having glypican 3-binding activity and the antibody variable region having T-cell receptor complex binding activity as comprised in the multispecific antigen-binding molecule which is comprised in the anticancer agent or the pharmaceutical composition of the present invention is not particularly limited as long as it has the above-described activities. However, in the present invention, the cytotoxic activity of the multispecific antigen-binding molecule is preferably equivalent to or greater than that of the bispecific antibody GPC3_ERY22_rCE115 described in Reference Example 3. Here, the term "equivalent" does not necessarily have to mean the same degree of activity as described above, and the activity may be enhanced. Being equivalent to GPC3_ERY22_rCE115 is, for example, when the value of (cell proliferation inhibition rate/cell proliferation inhibition rate (GPC3_ERY22_rCE115)) relative to the cell proliferation inhibition rate of GPC3_ERY22_rCE115 (cell proliferation inhibition rate (GPC3_ERY22_rCE115)) is 0.7 or greater, preferably 0.8 or greater, 0.9 or greater, 1.0 or greater, 1.2 or greater, 1.5 or greater, 2 or greater, 3 or greater, 5 or greater, 10 or greater, or 20 or greater. While there is no upper limit, the value may be, for example, 10, $10^2$, $10^3$, $10^4$, $10^5$, or $10^6$. The concentration of the multispecific antigen-binding molecule to be added can be determined appropriately, but is preferably, for example, 0.01 nM, 0.05 nM, 0.1 nM, 0.5 nM, or 1 nM; and preferably, measurements are taken at 0.05 nM or 0.1 nM.

Furthermore, examples include the case where the value (concentration for 50% inhibition of cell proliferation/concentration for 50% inhibition of cell proliferation (GPC3_ERY22_rCE115)) obtained by comparison to the concentration for 50% inhibition of growth of GPC3_ERY22_rCE115 cells (concentration for 50% inhibition of cell proliferation (GPC3_ERY22_rCE115)) is 1.5 or less. The value for "concentration for 50% inhibition of cell proliferation/concentration for 50% inhibition of cell proliferation (GPC3_ERY22_rCE115)" is preferably 1.3 or less, more preferably 1.2 or less, 1.1 or less, 1.0 or less, 0.9 or less, 0.8 or less, 0.7 or less, 0.6 or less, or 0.5 or less. While there is no lower limit, the value may be for example, $10^{-1}$, $10^{-2}$, $10^{-3}$, $10^{-4}$, $10^{-5}$, or $10^{-6}$. Specifically, the value is preferably $10^{-6}$ to $1.5 \times 10^{-0}$, more preferably $10^{-6}$ to $10^{-1}$, even more preferably $10^{-6}$ to $10^{-2}$, and yet even more preferably $10^{-6}$ to $10^{-3}$.

The preferred specific KD values for human GPC3 and human T cell receptor complex (for example, human CD3ε chain) are also as indicated above. Desired cells showing GPC3 expression or desired tissues containing these cells may be used for the cells, and for example, PC-10 or NCI-H446 which are GPC3-expressing human cancer cell lines can be used.

Examples of such a combination of the antibody variable region having glypican 3-binding activity and the antibody variable region having T-cell receptor complex binding activity, include the combinations of antibody H-chain variable regions shown in Table 4, combinations of antibody H-chain variable regions having CDR sequences whose CDR1, CDR2, and CDR3 amino acid sequences are the same as the CDR1, CDR2, and CDR3 amino acid sequences carried by the antibody H-chain variable regions of Table 4, and combinations of antibody H-chain variable regions functionally equivalent to these variable regions. Here, "functionally equivalent" has the same meaning described above.

TABLE 4

| GPC3 side/T cell receptor complex side | SEQ ID NO: |
|---|---|
| H0000/hCE115HA | 40/52 |
| H0000/CE115HA251 | 40/500 |
| H0000/CE115HA236 | 40/429 |
| H0000/TR01H002 | 40/421 |
| H0000/CE115HA122 | 40/426 |
| H0610/rCE115H | 215/424 |
| H0610/TR01H040 | 215/103 |
| H0610/TR01H061 | 215/122 |
| H0610/TR01H068 | 215/129 |
| H0610/TR01H071 | 215/132 |
| GCH054/TR01H067 | 197/128 |
| GCH094/TR01H082 | 211/142 |
| GCH094/TR01H084 | 211/144 |
| GCH065/TR01H084 | 206/144 |
| GCH065/TR01H082 | 206/142 |
| GCH094/TR01H109 | 211/164 |
| GCH065/TR01H109 | 206/164 |
| GCH094/TR01H113 | 211/168 |
| GCH065/TR01H113 | 206/168 |

A preferred common L chain for such combinations of an antibody variable region having glypican 3-binding activity and an antibody variable region having T-cell receptor complex binding activity includes, for example, L0000, L0011, L0201, L0203, L0204, L0206, L0208, L0209, L0211, L0212, L0222, and a common L chain having CDR sequences (CDR1, CDR2, and CDR3 amino acid sequences) identical to the CDR1, CDR2, and CDR3 amino acid sequences as in the above common L chain. Specific combinations include, for example, the combinations of antibody H-chain variable regions and a common L chain shown in Table 5, combinations of antibody variable regions having CDR sequences (CDR1, CDR2, and CDR3 amino acid sequences) identical to the amino acid sequences of CDR1, CDR2, and CDR3 carried by the antibody variable regions and a common L chain of Table 5, and combinations of antibody H-chain variable regions and a common L chain functionally equivalent to these variable regions. Here, "functionally equivalent" has the same meaning as described above.

TABLE 5

| GPC3 side/T cell receptor complex side/common L chain | SEQ ID NO: |
|---|---|
| H0610/rCE115H/L0000 | 215/424/53 |
| H0610/TR01H040/L0000 | 215/103/53 |
| H0610/TR01H040/L0201 | 215/103/299 |
| H0610/TR01H040/L0203 | 215/103/301 |
| H0610/TR01H040/L0204 | 215/103/302 |
| H0610/TR01H040/L0206 | 215/103/304 |
| H0610/TR01H040/L0208 | 215/103/306 |
| H0610/TR01H040/L0209 | 215/103/307 |
| H0610/TR01H040/L0211 | 215/103/309 |
| H0610/TR01H061/L0000 | 215/122/53 |
| H0610/TR01H068/L0000 | 215/129/53 |
| H0610/TR01H071/L0000 | 215/132/53 |
| GCH054/TR01H067/L0201 | 197/128/299 |
| GCH054/TR01H067/L0212 | 197/128/310 |
| GCH054/TR01H067/L0222 | 197/128/319 |
| GCH054/TR01H067/L0000 | 197/128/53 |
| GCH094/TR01H082/L0201 | 211/142/299 |
| GCH094/TR01H082/L0011 | 211/142/223 |
| GCH094/TR01H084/L0011 | 211/144/223 |
| GCH065/TR01H084/L0011 | 206/144/223 |
| GCH065/TR01H082/L0011 | 206/142/223 |
| GCH094/TR01H109/L0011 | 211/164/223 |
| GCH065/TR01H109/L0011 | 206/164/223 |
| GCH094/TR01H113/L0011 | 211/168/223 |
| GCH065/TR01H113/L0011 | 206/168/223 |

The Fc region comprised in the multispecific antigen-binding molecule which is comprised in the anticancer agent or the pharmaceutical composition of the present invention is not particularly limited as long as it is an Fc region having reduced Fcγ receptor-binding activity, but examples of a preferred Fc region of the present invention include a combination of the Fc-region portion of E22Hh and the Fc-region portion of E22Hk, a combination of the Fc-region portion of E2702GsKsc and the Fc-region portion of E2704sEpsc, and a combination of the Fc-region portion of E2702sKsc and the Fc-region portion of E2704sEpsc.

Examples of a preferred multispecific antigen-binding molecule comprised in an anticancer agent or a pharmaceutical composition of the present invention include bispecific antibodies comprising an antibody variable region having glypican 3-binding activity and an antibody variable region having CD3ε-binding activity. More preferably, the cytotoxic activity is the same or greater than that of the GPC3_ERY22_rCE115 bispecific antibody. Examples of such bispecific antibodies include bispecific antibodies comprising H and L chains described in Table 17, and bispecific antibodies that bind to an epitope overlapping with an epitope bound by the above antibodies, and which contain an Fc region with reduced Fcγ receptor-binding activity.

Whether an antibody recognizes an epitope that overlaps with an epitope recognized by another antibody can be confirmed by the competition between the two antibodies against the epitope. Competition between the antibodies can be evaluated by competitive binding assays using means such as enzyme-linked immunosorbent assay (ELISA), fluorescence energy transfer method (FRET), and fluorometric microvolume assay technology (FMAT (Registered trademark)). The amount of an antibody bound to an antigen indirectly correlates with the binding ability of a candidate competitor antibody (a test antibody) that competitively binds to the overlapping epitope. In other words, as the amount or affinity of a test antibody against the overlapping epitope increases, the amount of the antibody bound to the antigen decreases, and the amount of the antigen-bound test antibody increases. Specifically, the appropriately labeled antibody and antibody to be evaluated are simultaneously added to the antigen, and the antibody bound as a result are detected using the label. The amount of the antigen-bound antibody can be easily determined by labeling the antibody beforehand. This label is not particularly limited, and the labeling method is selected according to the assay technique used. Specifically, the labeling method includes fluorescent labeling, radiolabeling, enzymatic labeling, and such.

For example, the fluorescently labeled antibody and the unlabeled antibody or test antibody are simultaneously added to beads immobilized with GPC3 or CD3ε, and the labeled antibody is detected by fluorometric microvolume assay technology.

Herein, the "antibody that binds to the overlapping epitope" refers to a test antibody that can reduce the amount of the bound labeled antibody by at least 50% at a concentration that is usually 100 times higher, preferably 80 times higher, more preferably 50 times higher, even more preferably 30 times higher, and still more preferably 10 times higher than the concentration at which the non-labeled antibody reduces 50% of the amount of the labeled antibody bound ($IC_{50}$).

Multispecific antigen-binding molecules, which have the antigen-binding sites of antibodies that bind to epitopes overlapping with epitopes bound by the above-mentioned antibodies, can yield excellent cytotoxic activity.

The multispecific antigen-binding molecules of the present invention are produced by the same technique as the method for producing recombinant antibodies mentioned above.

Combination Therapies and Pharmaceutical Compositions

In a non-limiting embodiment of the present invention, the combination therapy of the present invention provides methods for damaging cells, for suppressing cell proliferation, for activating immunity towards cancer cells or cancer cell-comprising tumor tissues, for treating cancer, or for preventing cancer, each of the methods comprising administering effective amounts of the above-described bispecific antibody and another anticancer agent. In several embodiments, the combination therapy of the present invention is highly effective for damaging cells, suppressing cell proliferation, activating immunity towards cancer cells or cancer cell-comprising tumor tissues, treating cancer, or preventing cancer, as compared to monotherapy using the above-described bispecific antibody or the other anticancer agent. In another embodiment, the combination therapy of the present invention has synergistic effects or additive effects on damaging cells, suppressing cell proliferation, activating immunity towards cancer cells or cancer cell-comprising tumor tissues, treating cancer, or preventing cancer.

In several embodiments, the term "effective amount" in the present invention refers to a dose of the above-described bispecific antibody and/or another anticancer agent that is effective for treating or preventing a disease in an individual. The disease is not particularly limited but is preferably cancer.

In several embodiments, "treatment/treating/therapeutic" in the present invention means that the combination therapy of the present invention decreases the number of cancer cells in individuals, suppresses cancer cell proliferation, decreases tumor size, suppresses infiltration of cancer cells into peripheral organs, suppresses cancer cell metastasis, or ameliorates various symptoms caused by cancer. Furthermore, in several embodiments, "prevention/preventing/prophylactic" in the present invention refers to inhibiting increase in the number of cancer cells due to repopulation of cancer cells that have been decreased, inhibiting repopulation of cancer cells whose proliferation has been suppressed, and inhibiting the decreased tumor size to become large again.

In several embodiments, the combination therapy of the present invention provides methods for enhancing therapeutic or prophylactic effects of the other anticancer agent by using the above-described bispecific antibody, in cancer treatment or prevention with the other anticancer agent. In another embodiment, the combination therapy of the present invention provides methods for enhancing therapeutic or prophylactic effects of the above-described bispecific antibody by using the other anticancer agent, in cancer treatment or prevention with the bispecific antibody. Herein, enhancement of therapeutic or prophylactic effects refers to, for example, increase in efficacy rate of the treatment, decrease in the amount of the anticancer agent that is administered for the treatment, and/or shortening of the period of the treatment with an anticancer agent, but is not limited thereto. In another embodiment, the combination therapy of the present invention provides methods for extending progression-free survival in individuals, the method comprising administering an effective amount of the above-described bispecific antibody and another anticancer agent.

In several embodiments, the combination therapy of the present invention comprises administering the above-described bispecific antibody and another anticancer agent.

The bispecific antibody and the other anticancer agent can be administered by any appropriate methods known in the art. For example, the bispecific antibody and the other anticancer agent can be administered in parallel (i.e., simultaneously) or successively (i.e., at different time points). In several embodiments, when the bispecific antibody and the other anticancer agent are administered successively (i.e., at different time points), the interval between administration of the bispecific antibody and the other anticancer agent is not particularly limited and the interval can be determined by taking account for factors such as the administration route and dosage form. The interval is, for example, 0 to 168 hours, preferably 0 to 72 hours, more preferably 0 to 24 hours, and even more preferably 0 to 12 hours, but is not limited thereto.

In several embodiments, the above-described bispecific antibody and the other anticancer agent are administered simultaneously. In several embodiments, the bispecific antibody is administered at intervals (i.e., intermittently). In several embodiments, the bispecific antibody is administered before administration of the other anticancer agent. In several embodiments, the bispecific antibody is administered after administration of the other anticancer agent.

In several embodiments, the other anticancer agent is administered at intervals (i.e., intermittently). In several embodiments, the other anticancer agent is administered before administration of the bispecific antibody. In several embodiments, the other anticancer agent is administered after administration of the bispecific antibody.

In several embodiments, the bispecific antibodies described herein and anticancer agents which are known or described herein can be used in the above-described combination therapies using bispecific antibodies and other anticancer agents.

In several embodiments, an additional therapy can be performed in addition to the combination therapies using the above-described bispecific antibody and another anticancer agent. In several embodiments, a therapy to add to the combination therapy of the present invention may comprise additional administration of the bispecific antibody and/or the other anticancer agent.

A non-limiting embodiment of the present invention provides agents for inducing cytotoxicity, agents for suppressing cell proliferation (agents for inhibiting cell proliferation), agents for activating immune response towards cancer cells or cancer cell-comprising tumor tissues, agents for treating cancer, and agents for preventing cancer (herein below, referred to as pharmaceutical compositions and such), each comprising the above-described bispecific antibody, another anticancer agent, or a combination of the bispecific antibody and the other anticancer agent. In several embodiments, the pharmaceutical compositions and such of the present invention can be used in the combination therapy of the present invention. In several embodiments, the pharmaceutical compositions and such of the present invention are highly effective for damaging cells, suppressing cell proliferation, activating immunity towards cancer cells or cancer cell-comprising tumor tissues, treating cancer, or preventing cancer due to combined use of the above-described bispecific antibody and the other anticancer agent, as compared to monotherapy using the bispecific antibody or the other anticancer agent. In another embodiment, the pharmaceutical compositions of the present invention have synergistic effects or additive effects on damaging cells, suppressing cell proliferation, activating immunity towards cancer cells or cancer cell-comprising tumor tissues, treating cancer, or preventing cancer due to combined use of the above-described bispecific antibody and the other anticancer agent.

In several embodiments, the pharmaceutical compositions and such according to the present invention "comprising a combination of a bispecific antibody and another anticancer agent" refers to pharmaceutical compositions and such in which the above-described bispecific antibody and the other anticancer agent are combined for use in simultaneous, separate, or sequential administration in treatment or prevention of a disease. For example, the pharmaceutical compositions and such of the present invention can be provided in the form of a combination preparation containing both a bispecific antibody and another anticancer agent. Alternatively, for example, as the pharmaceutical compositions and such of the present invention, a pharmaceutical agent containing a bispecific antibody and a pharmaceutical agent containing another anticancer agent can be separately provided, and these pharmaceutical agents may be used simultaneously or sequentially. The disease is not particularly limited but is preferably cancer.

In several embodiments, the present invention provides pharmaceutical compositions and such for use in combination with another anticancer agent, the compositions comprising the above-described bispecific antibody as an active ingredient.

In several embodiments, the present invention provides pharmaceutical compositions and such for use in combination with the above-described bispecific antibody, the compositions comprising another anticancer agent as an active ingredient.

In several embodiments, the present invention provides pharmaceutical compositions and such for enhancing therapeutic effects of another anticancer agent in cancer treatment with said another anticancer agent, by using the above-described bispecific antibody in combination with said another anticancer agent.

In several embodiments, the present invention provides pharmaceutical compositions and such for enhancing therapeutic effects of the above-described bispecific antibody in cancer treatment with the bispecific antibody, by using another anticancer agent in combination with the bispecific antibody.

In several embodiments, the present invention provides use of the above-described bispecific antibody and/or another anticancer agent for the production of pharmaceutical compositions and such comprising as active ingredients the bispecific antibody and/or the other anticancer agent.

In the present invention, "comprising as active ingredients the above-described bispecific antibody and/or another anticancer agent" means "containing the bispecific antibody and/or the other (another) anticancer agent as major active component(s)", and does not limit the content of the bispecific antibody and/or the other anticancer agent.

In several embodiments, the bispecific antibodies described herein and other anticancer agents which are known or described herein can be used in the above-described pharmaceutical compositions and others.

In a non-limiting embodiment of the present invention, the above-described other anticancer agents include, but are not limited to, nitrogen mustard analogues, alkyl sulfonates, ethylene imines, nitrosoureas, epoxides, other alkylating agents, folic acid analogues, purine analogues, pyrimidine analogues, other antimetabolites, vinca alkaloids or analogues, podophyllotoxin derivatives, camptothecin analogues, colchicine derivatives, taxanes, other plant alkaloids or natural substances, actinomycines, anthracyclines or related substances, other cytotoxic antibiotics, platinum compounds, methylhydrazines, kinase inhibitors, angiogenic inhibitors, hormonal agents, inhibitors of DNA modification enzymes, immunostimulators, proteasome inhibitors, enzymes, histone deacetylase inhibitors, inhibitors of DNA modification enzymes, cytokine preparations, retinoids, immune checkpoint inhibitors, indoleamine 2,3-Dioxygenase (IDO) inhibitors, co-stimulatory molecule activators, natural killer cell activators, monoclonal antibodies, other molecular-targeted agents, and other anticancer agents. In a non-limiting embodiment, other anticancer agents in the present invention include, but are not limited to, for example, antibodies described in WO2015/174439 and WO2015/156268.

In several embodiments, an "immune checkpoint" of the present invention refers to a molecule that is expressed on immunocompetent cells (including T cells) and binds to a ligand to thereby transduce to the immunocompetent cells signals inhibiting immune response. Examples of immune checkpoints and ligands thereof include, but are not limited to, molecules such as PD-1, CTLA-4, TIM3, LAG3, PD-L1, PD-L2, BTNL2, B7-H3, B7-H4, CD48, CD80, 2B4, BTLA, CD160, CD60, CD86, and VISTA. In several embodiments, an "immune checkpoint inhibitor" of the present invention refers to a pharmaceutical agent that inhibits binding between an immune checkpoint and its ligand, and thereby inhibits signal transduction mediated by the immune checkpoint.

A non-limiting embodiment of the present invention provides pharmaceutical compositions and such in which the other anticancer agent is a chemotherapeutic agent, a T cell-activating agonist agent, an immune checkpoint inhibitor, or an angiogenic inhibitor.

In a non-limiting embodiment of the present invention, chemotherapeutic agents include, but are not limited to, antimetabolites, plant alkaloids, and platinum compounds. Preferred examples of an antimetabolite include, but are not limited to, enocitabine, capecitabine, carmofur, gemcitabine, cytarabine, tegafur, tegafur uracil, nelarabine, fluorouracil, fludarabine, pemetrexed, pentostatin, and methotrexate. Particularly preferred antimetabolites include, for example, capecitabine. Preferred examples of a plant alkaloid include, but are not limited to, irinotecan, etoposide, sobuzoxane, docetaxel, nogitecan, paclitaxel, vinorelbine, vincristine, vindesine, and vinblastine. Particularly preferred plant alkaloids include, for example, paclitaxel. Preferred examples of a platinum compound include, but are not limited to, oxaliplatin, carboplatin, cisplatin, and nedaplatin. Particularly preferred platinum compounds include, for example, cisplatin.

In a non-limiting embodiment of the present invention, T cell-activating agonist agents include, but are not limited to, TNF receptor superfamily (TNFRSF) agonist antibodies and co-stimulatory molecule agonist antibodies against. Target molecules of "TNF receptor superfamily agonist antibodies" are not particularly limited as long as they are factors that activate cells expressing the TNF receptor superfamily (for example, T cells and NK cells), but are preferably factors belonging to the "TNF superfamily" or the "TNF receptor superfamily". Known factors belonging to the "TNF superfamily" or the "TNF receptor superfamily" include ligands having a trimeric structure and receptors having a trimeric structure to which the ligands bind, which contribute to activation of various immune cells (Nat. Rev. Immunol., 2012, 12, 339-51). Examples of a factor belonging to the TNF superfamily or TNF receptor superfamily include CD137, CD137L, CD40, CD40L, OX40, OX40L, CD27, CD70, HVEM, LIGHT, RANK, RANKL, CD30, CD153, GITR, GITRL, TNFRSF25, and TL1A. Preferred factors include, for example, CD137. Examples of a CD137 agonist antibody include Urelumab (CAS No. 934823-49-1), PF-05082566, and various known CD137 agonist antibodies.

Factors belonging to co-stimulatory molecules include TMIGD2, HHLA2, ICOS, ICOS ligand, CD28, CD80, CD86, and such. Examples of an OX40 agonist antibody include MOXR0916, MEDI6469, MEDI0562, MEDI6383, PF-04518600, GSK-3174998, and various known OX40 agonist antibodies. Examples of a CD40 agonist antibody include RG-7876, ADC-1013, SEA-CD40, APX005M, Dacetuzumab, and various known CD40 agonist antibodies. Examples of a GITR agonist antibody include AMG228, AMK-1248, MK-4166, BMS-986156, TRX518, and various known GITR agonist antibodies. Examples of a CD27 agonist antibody include Varlilumab (CAS No. 1393344-72-3) and various known CD27 agonist antibodies.

In a non-limiting embodiment of the present invention, preferred examples of an immune checkpoint inhibitor include, but are not limited to, PD1 antibodies, PDL1 antibodies, CTLA-4 antibodies, TIM3 antibodies, and LAG3 antibodies. Examples of a PD-1 antibody include Pembrolizumab (CAS No. 1374853-91-4), Nivolumab (CAS No. 946414-94-4), MEDI0680, PDR001, BGB-A317, REGN2810, SHR-1210, PF-06801591, and various known PD1 antibodies. Examples of a PD-L1 antibody include Atezolizumab (CAS No. 1380723-44-3), Avelumab (CAS No. 1537032-82-8), Durvalumab (CAS No. 1428935-60-7), MDX-1105, and various known PD-L1 antibodies. Examples of a CTLA-4 antibody include Ipilimumab (CAS No. 477202-00-9), Tremelimumab (CAS No. 745013-59-6), and various known CTLA-4 antibodies. Examples of a TIM3 antibody include MBG452 and various known TIM3 antibodies. Examples of an LAG3 antibody include BMS-986016, LAG525, and various known LAG3 antibodies.

In a non-limiting embodiment of the present invention, preferred examples of an angiogenic inhibitor include, but are not limited to, VEGFR2 antibodies. Examples of an angiogenic inhibitor include Bevacizumab, Sorafenib, Everolimus, Temsirolimus, and various known angiogenic inhibitors.

In several embodiments, other anticancer agents of the present invention are not particularly limited and any anticancer agent can be used as long as, when used in combination with the bispecific antibody of the present invention, therapeutic effect or prophylactic effect of the other anticancer agent is enhanced or therapeutic effect or prophylactic effect of the bispecific antibody is enhanced.

In a non-limiting embodiment of the present invention, the combination therapy of the present invention may comprise the above-described bispecific antibody and at least one other therapeutic agent, an immunomodulator, a therapeutic cancer vaccine, adoptive T cell therapy, Treg depletion, or such, but the therapy is not limited thereto. Preferred therapeutic cancer vaccines include, but are not limited to, whole tumor cell vaccines, tumor antigen vaccines, vector-based vaccines, oncolytic viral vaccines, and dendritic cell vaccines. Multimodality therapy may be performed using surgical operation, radiation treatment, or such in combination, in addition to the above-described therapies.

In a non-limiting embodiment of the present invention, the combination therapy of the present invention can be performed using the above-described bispecific antibody in combination with cytokine therapy using a cytokine as an anti-tumor immune response-enhancing agent. In such therapy, cytokines include, but are not limited to, IL-2, IL-7, IL-12, IL-15, IL-17, IL-18, IL-21, IL-23, IL-27, GM-CSF, interferon-α (IFNα), IFNα-2b, IFNβ, and IFNγ.

A non-limiting embodiment of the present invention provides agents for inducing cytotoxicity, agents for suppressing cell proliferation, agents for inhibiting cell proliferation, agents for activating immune response, agents for treating cancer, and agents for preventing cancer, each comprising the above-described pharmaceutical composition.

In several embodiments, an "individual" to which the above-described bispecific antibody and/or another anticancer agent is administered refers to a human or a non-human animal, for example, a mammal such as cattle, horse, dog, sheep, or cat. The individual is preferably a human. The individual includes patients (including human and non-human mammals). In several embodiments, the individual is a patient who has cancer cells or cancer cell-comprising tumor tissues. Cancer cells or cancer cell-comprising tumor tissues which become targets of the anticancer agent or the combination therapy of the present invention are not particularly limited, as long as they express glypican 3. In the present invention, preferred glypican 3-expressing cells, i.e., glypican 3-positive cells, are cancer cells. More preferred cancer types include, but are not limited to, for example, gastric cancer, head and neck cancer (H&N), esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer (adrenal gland), anus cancer, central nervous system tumor, neuroendocrine tissue tumor, penis cancer, pleura tumor, salivary gland tumor, vulva cancer, thymoma, and childhood cancer (Wilms tumor, neuroblastoma, sarcoma, hepatoblastoma, and germ cell tumor). Still more preferred cancer types include, but are not limited to, gastric cancer, head and neck cancer (H&N), esophageal cancer, lung cancer, liver cancer, ovary cancer, breast cancer, colon cancer, kidney cancer, skin cancer, muscle tumor, pancreas cancer, prostate cancer, testis cancer, and uterine cancer (Tumori. (2012) 98, 478-484; Tumor Biol. (2015) 36, 4671-4679; Am J Clin Pathol (2008) 130, 224-230; Adv Anat Pathol (2014) 21, 450-460; Med Oncol (2012) 29, 663-669; Clinical Cancer Research (2004) 10, 6612-6621; Appl Immunohistochem Mol Morphol (2009) 17, 40-46; Eur J Pediatr Surg (2015) 25, 138-144; J Clin Pathol (2011) 64, 587-591; Am J Surg Pathol (2006) 30, 1570-1575; Oncology (2007) 73, 389-394; Diagnostic Pathology (2010) 64, 1-6; Diagnostic Pathology (2015) 34, 1-6; Am J Clin Pathol (2008) 129, 899-906; Virchows Arch (2015) 466, 67-76).

In several embodiments, patients are those who have received treatment with the above-described bispecific antibody and/or some kind of anticancer agent(s) prior to the combination therapy using the bispecific antibody and another anticancer agent. In several embodiments, patients are those who cannot receive standard therapy or for whom standard therapy is ineffective. In several embodiments, cancer which a patient has is early-stage or end-stage.

As used herein, "cancer" refers not only to epithelial malignancy such as ovary cancer or gastric cancer but also to non-epithelial malignancy including hematopoietic tumors such as chronic lymphocytic leukemia or Hodgkin's lymphoma. Herein, the terms "cancer", "carcinoma", "tumor", "neoplasm" and such are not differentiated from each other and are mutually interchangeable.

Meanwhile, in several embodiments, cancer types which become targets of anticancer agents or pharmaceutical compositions (combination therapy) of the present invention are preferably those in which the number of glypican-3 antigens on the cell surface per cell is 100 or more, more preferably those in which the number of glypican-3 antigens on the cell surface per cell is 200 or more, 300 or more, 400 or more, 500 or more, 600 or more, 700 or more, 800 or more, 900 or more, 1000 or more, 1200 or more, 1400 or more, 1600 or more, 1800 or more, or 2000 or more, and still more preferably those in which the number of glypican-3 antigens on the cell surface per cell is 3000 or more, 4000 or more, 5000 or more, 6000 or more, 7000 or more, 8000 or more, 9000 or more, 10000 or more, 20000 or more, 30000 or more, 40000 or more, or 50000 or more.

The number of glypican-3 antigens on cell surface per cell can be appropriately determined using methods described herein or known to those skilled in the art, for example, by calculating antibody binding capacity (ABC) of GPC3 on the cell surface with flow cytometry using QIFIKIT (DAKO). The number of glypican-3 antigens on cell surface per cell in a tissue sample isolated from a target candidate can be determined in order to assess whether the candidate can be a target to which an anticancer agent or pharmaceutical composition (combination therapy) of the present invention is administered. When in the sample the number of glypican-3 antigens on cell surface per cell meets the criterion described above, the target from which the sample is derived can be the target to which the anticancer agent or pharmaceutical composition (combination therapy) of the present invention is administered.

In a non-limiting embodiment of the present invention, anticancer agents of the present invention can be used to treat patients who have cancer which is refractory to treatment with an immune checkpoint inhibitor. For example, patients with glypican 3-positive cancer, in whom administration of an immune checkpoint inhibitor has failed to achieve a desired drug efficacy, can be treated with the anticancer agent of the present invention. In other words, glypican 3-positive cancer that has been already treated with therapy using an immune checkpoint inhibitor can be treated with the anticancer agent of the present invention.

In a non-limiting embodiment of the present invention, pharmaceutical compositions (combination therapy) of the present invention can be used to treat patients who have cancer which is refractory to treatment with an immune checkpoint inhibitor. For example, patients with GPC-positive cancer, in whom administration of an immune checkpoint inhibitor has failed to achieve a desired drug efficacy, can be treated with the pharmaceutical composition (combination therapy) of the present invention. In other words, glypican 3-positive cancer that has been already treated with therapy using an immune checkpoint inhibitor can be treated with the pharmaceutical composition (combination therapy) of the present invention. Preferred examples of another anticancer agent comprised in the pharmaceutical composition include immune checkpoint inhibitors, but are not limited thereto.

In a non-limiting embodiment of the present invention, pharmaceutical compositions (combination therapy) of the present invention can be used to treat patients who have cancer which is refractory to treatment with the anticancer agent of the present invention. For example, patients with GPC-positive cancer, whose cancer has become resistant to the anticancer agent of the present invention after administration of the anticancer agent or in whom administration of the anticancer agent of the present invention has failed to achieve a desired drug efficacy, can be treated with the pharmaceutical composition (combination therapy) of the present invention. In other words, glypican 3-positive cancer that has been already treated with therapy using the anticancer agent of the present invention can be treated with the pharmaceutical composition (combination therapy) of the present invention. Preferred examples of another anticancer agent comprised in the pharmaceutical composition include immune checkpoint inhibitors, but are not limited thereto.

With respect to glypican 3-positive cancer (cancer confirmed to express glypican 3), those skilled in the art can appropriate examine positivity for glypican 3 using methods known to those skilled in the art such as immunohistochemical staining or flow cytometry.

From another viewpoint, the present invention provides anticancer agents comprising as the active ingredient a multispecific antigen-binding molecule that comprises: (1) a domain comprising an antibody variable region having glypican 3-binding activity, (2) a domain comprising an antibody variable region having T-cell receptor complex-binding activity, and (3) a domain comprising an Fc region with reduced binding activity towards an Fcγ receptor.

In the present invention "comprising as the active ingredient a multispecific antigen-binding molecule that comprises (1) a domain comprising an antibody variable region having glypican 3-binding activity, (2) a domain comprising an antibody variable region having T-cell receptor complex-binding activity, and (3) a domain comprising an Fc region with reduced binding activity towards an Fcγ receptor" means comprising the antigen-binding molecule as a major active component, without limitation to the content ratio of the antigen-binding molecule.

If necessary, multispecific antigen-binding molecules of the present invention may be encapsulated in microcapsules (e.g., those made of hydroxymethylcellulose, gelatin, and poly(methylmethacrylate)), or incorporated as components of a colloidal drug delivery system (e.g., liposomes, albumin microspheres, microemulsion, nanoparticles, and nanocapsules) (see, for example, "Remington's Pharmaceutical Science 16th edition", Oslo Ed. (1980)). Methods for preparing the pharmaceutical agents as controlled-release pharmaceutical agents are also well known, and such methods may be applied to the multispecific antigen-binding molecules of the present invention (J. Biomed. Mater. Res. (1981) 15: 267-277; Chemtech. (1982) 12: 98-105; U.S. Pat. No. 3,773,719; European Patent Application Publication Nos. EP 58,481 and EP 133,988; Biopolymers (1983) 22: 547-556).

The pharmaceutical compositions or anticancer agents of the present invention may be administered to patients by oral or parenteral administration, and parenteral administration is preferred. Specific examples of the administration method include administration by injection, transnasal administration, transpulmonary administration, and transdermal administration. Examples of administration by injection include intravenous injection, intramuscular injection, intraperitoneal injection, and subcutaneous injection. A pharmaceutical composition or anticancer agent of the present invention can be administered systemically or locally, for example, through administration by injection. The method of administration can be selected appropriately according to the age and symptoms of the patient. The dose can be selected from the range of 0.0001 mg to 1000 mg per kilogram body weight for a single administration. Alternatively, for example, the dose may be selected from the range of 0.001 mg/body to 100000 mg/body per patient. The dose may be defined, for example, as the amount of the multispecific antigen-binding molecule of the present invention comprised as the active ingredient in the pharmaceutical composition. However, the pharmaceutical compositions or anticancer agents of the present invention are not limited to these doses.

The pharmaceutical compositions or anticancer agents of the present invention can be formulated according to conventional methods (for example, Remington's Pharmaceutical Science, latest edition, Mark Publishing Company, Easton, U.S.A), and may also contain pharmaceutically acceptable carriers and additives. Examples include, but are not limited to surfactants, excipients, coloring agents, perfumes, preservatives, stabilizers, buffers, suspending agents, isotonization agents, binders, disintegrants, lubricants, fluidity promoting agents, and flavoring agents; and other commonly used carriers can be suitably used. Specific examples of the carriers include light anhydrous silicic acid, lactose, crystalline cellulose, mannitol, starch, carmellose calcium, carmellose sodium, hydroxypropyl cellulose, hydroxypropyl methyl cellulose, polyvinylacetal diethylaminoacetate, polyvinylpyrrolidone, gelatin, medium chain fatty acid triglyceride, polyoxyethylene hardened castor oil 60, saccharose, carboxymethyl cellulose, corn starch, inorganic salt, and such.

A non-limiting embodiment of the present invention also provides methods for damaging glypican 3 antigen-expressing cells or tumor tissues containing the antigen-expressing cells, or methods for suppressing growth of these cells or tumor tissues by contacting the glypican 3 antigen-expressing cells with a multispecific antigen-binding molecule of the present invention that binds to the antigen and another anticancer agent. The multispecific antigen-binding molecule that binds to the antigen is as described above for an antigen-binding molecule of the present invention that binds to the antigen, which is comprised in the anticancer agents of the present invention. The cells bound by a multispecific antigen-binding molecule of the present invention that binds to the antigen are not particularly limited as long as they are cells expressing the antigen.

In the present invention, "contact" is carried out, for example, by adding a multispecific antigen-binding molecule of the present invention which binds to the antigen and another anticancer agent to the culture medium of GPC3 antigen-expressing cells cultured in vitro. In this case, a liquid or a solid obtained by freeze-drying or such may be suitably used as the form of the added antigen-binding molecule and/or another anticancer agent. When added as an aqueous solution, it may be an aqueous solution that simply contains only the multispecific antigen-binding molecule of the present invention, or it may be a solution containing also, for example, the above-mentioned surfactants, excipients, coloring agents, perfumes, preservatives, stabilizers, buffers, suspending agents, isotonization agents, binders, disintegrants, lubricants, fluidity promoting agents, and flavoring agents. The concentration at which the addition is performed is not particularly limited, but a suitable final concentration in the culture solution is preferably in the range of 1 pg/ml to 1 g/ml, more preferably 1 ng/ml to 1 mg/ml, and even more preferably 1 µg/mL to 1 mg/mL.

Furthermore, in another embodiment, "contact" of the present invention is also carried out by administering an antigen-binding molecule of the present invention and another anticancer agent to non-human animals with cells expressing the GPC3 antigen transplanted into their bodies, and to animals carrying cells that intrinsically express the antigen. The method of administration may be oral or parenteral, and parenteral administration is particularly preferred. Specific examples of the administration method include administration by injection, transnasal administration, transpulmonary administration, and transdermal administration. Examples of administration by injection include intravenous injection, intramuscular injection, intraperitoneal injection, and subcutaneous injection. A pharmaceutical composition or anticancer agent of the present invention can be administered systemically or locally, for example, through administration by injection. The method of administration can be selected appropriately according to the age and symptoms of the test animal. When administered as an aqueous solution, an aqueous solution containing simply only a multispecific antigen-binding molecule of the present invention may be used, or a solution containing also the above-mentioned surfactants, excipients, coloring agents, perfumes, preservatives, stabilizers, buffers, suspending agents, isotonization agents, binders, disintegrants, lubricants, fluidity promoting agents, flavoring agents, and such may be used. The dose can be selected from the range of 0.0001 mg to 1000 mg per kilogram body weight for a single administration. Alternatively, for example, the dose may be selected from the range of 0.001 mg/body to 100000 mg/body per patient. The dose may be defined, for example, as the amount of the multispecific antigen-binding molecule of the present invention comprised as the active ingredient in the pharmaceutical composition. However, the amount of the multispecific antigen-binding molecule of the present invention administered is not limited to these doses.

The following method is suitably used as a method for evaluating or measuring cytotoxicity induced in cells expressing the glypican 3 antigen which is bound by a domain carrying an antibody variable region having glypican 3-binding activity that constitutes the antigen-binding molecule as a result of contacting the cells with a multispecific antigen-binding molecule or another anticancer agent of the present invention. Examples of a method for evaluating or measuring the cytotoxic activity in vitro include methods for measuring cytotoxic T cell activity and such. Whether or not a multispecific antigen-binding molecule of the present invention has T cellular cytotoxicity can be measured by known methods (for example, Current protocols in Immunology, Chapter 7. Immunologic studies in humans, Editor, John E. Coligan et al., John Wiley & Sons, Inc., (1993) and the like). For activity measurements, an antigen-binding molecule that binds to an antigen different from glypican 3, which is an antigen not expressed in the cells used for the examination, can be used as a control in the same manner as a multispecific antigen-binding molecule of the present invention, and the activity can be determined to be present when the multispecific antigen-binding molecule of the present invention shows a stronger cytotoxic activity than when the antigen-binding molecule is used as a control.

To evaluate or measure cytotoxic activity in vivo, for example, cells expressing a glypican 3 antigen are intradermally or subcutaneously transplanted to a non-human test animal, and then a test antigen-binding molecule and/or another anticancer agent is intravenously or intraperitoneally administered daily or with an interval of few days, starting from the day of transplantation or the following day. Cytotoxic activity can be determined by daily measurement of tumor size and by observing difference in the change of tumor size. In a similar manner to the in vitro evaluation, the cytotoxic activity of an antigen-binding molecule of the present invention can be determined to be present when administration of a control antigen-binding molecule shows that the tumor size in the group subjected to administration of an antigen-binding molecule of the present invention is significantly smaller than the tumor size in the group subjected to administration of the control antigen-binding molecule.

As a method for evaluating or measuring the suppressive effect on proliferation of cells expressing a glypican 3 antigen, a method of measuring the uptake of isotope-labeled thymidine into cells or the MTT method may be suitably used. As a method for evaluating or measuring the cell proliferation-suppressing activity in vivo, the same method described above for evaluating or measuring cytotoxic activity in vivo may be suitably used.

Kits

In several embodiments, the present invention provides a kit comprising:
(1) the above-described bispecific antibody;
(2) a container; and
(3) an instruction or a label indicating that the bispecific antibody and at least one type of anticancer agent are administered in combination to a test subject for treating cancer in an individual.

In another embodiment, the present invention provides a kit comprising:
(1) another anticancer agent;
(2) a container; and
(3) an instruction or a label indicating that said another anticancer agent and at least one type of the above-described bispecific antibody are administered in combination to an individual for treating cancer in the individual.

In another embodiment, the present invention provides a kit comprising:
(1) the above-described bispecific antibody;
(2) another anticancer agent;
(3) a container; and
(4) an instruction or a label indicating that the bispecific antibody and the other anticancer agent are administered in combination to an individual for treating cancer in the individual.

In several embodiments, the kit further comprises a pharmaceutically acceptable carrier. The kit can further comprise a sterile diluent preferably stored in a separate, additional container. The kit can also comprise an instruction relating to a combination therapy for treating or preventing cancer.

In several embodiments, an "instruction" refers to the written instruction usually contained in a commercially available box carrying a pharmaceutical, and can include information on indications, usage, dose, administration, contraindications, and/or warnings regarding the use of the pharmaceutical.

The kits may be those which are used exclusively for the purpose of combined use of the bispecific antibody of the present invention and another anticancer agent. Alternatively, the kits may be those which are used for other purposes as long as they are used for the purpose of combined use of the bispecific antibody of the present invention and another anticancer agent. For example, as long as the instruction or label of the kit of the present invention indicates that the bispecific antibody and other anticancer agent are administered in combination to an individual, the instruction or label may indicate other embodiments, for example, in which the bispecific antibody or other anticancer agent is used alone.

The present invention also relates to molecules having GPC3-binding activity, which contain a domain comprising an antibody variable region having GPC3-binding activity of the multispecific antigen-binding molecule comprised in the anticancer agent or pharmaceutical composition of the present invention. Furthermore, the present invention relates to a molecule having GPC3-binding activity, which comprises the antibody variable regions of H and L chains respectively comprising the three CDRs of the H and L chains (total of six CDRs) contained in the molecule. The present invention also relates to molecules having T-cell receptor complex-binding activity, which contain a domain comprising an antibody variable region having T-cell receptor complex-binding activity of the multispecific antigen-binding molecule comprised in the anticancer agent or pharmaceutical composition of the present invention. Furthermore, the present invention relates to a molecule having T-cell receptor complex-binding activity that comprises the antibody variable regions of the H and L chains respectively comprising the three CDRs of the H and L chains (total of six CDRs) contained in the molecule. Such molecules may be antibodies or polypeptides comprising antigen-binding fragments of an antibody. The present invention also relates to antibodies that bind to epitopes overlapping or competing with these molecules or polypeptides containing the antigen-binding fragments thereof. Suitable examples of such polypeptides comprising antigen-binding fragments of an antibody include scFv, single chain antibody, Fv, single chain Fv 2 (scFv2), Fab, and F(ab')$_2$. Furthermore, these molecules do not have to be multispecific (bispecific), and may bind only to either GPC3 or a T cell receptor complex (for example, the CD3ε chain).

These molecules include a molecule comprising a domain that comprises an antibody variable region having GPC-binding activity of the multispecific antigen-binding molecule exemplified in detail in the Reference Examples herein (which comprises the H-chain variable regions having GPC3-binding activity and the common L-chain variable region), a molecule comprising a domain that comprises an antibody variable region having T cell receptor complex-binding activity of the multispecific antigen-binding molecule exemplified in the Reference Examples herein (which comprises the H-chain variable regions having T cell receptor complex-binding activity and the common L-chain variable region), and also a molecule having an activity to bind to the same antigenic protein (GPC3 or T-cell receptor complex), which comprises the three CDRs of each of the H and L chains (total of six CDRs) contained in the above molecule.

These molecules have CDRs that are in common with those of a multispecific antigen-binding molecule of the present invention; and therefore, they are expected to bind to an epitope overlapping with an epitope for the multispecific antigen-binding molecule of the present invention. Therefore, these molecules can compete with multispecific antigen-binding molecules of the present invention when they coexist with the multispecific antigen-binding molecules of the present invention. Accordingly, these molecules can be used, for example, as regulatory agents for suppressing activities (such as antigen-binding activity, cytotoxic activity, and antitumor activity) of the multispecific antigen-binding molecules of the present invention. Furthermore, such a molecule can be bound to a target protein (GPC3 or T cell receptor complex) in advance, and when a multispecific antigen-binding molecule of the present invention is added, the molecules that dissociate through competition can be detected. This way, the molecule is useful as an agent for detecting binding of a multispecific antigen-binding molecule of the present invention to a target protein. Here, such molecules may be labeled appropriately with fluorescent substances or such. Alternatively, these molecules are useful for screening novel antibodies that bind to epitopes overlapping with the epitopes bound by the multispecific antigen-binding molecules of the present invention. As described above, such a molecule can be bound to a target protein (GPC3 or T cell receptor complex) in advance, and when a test antibody is added, if the bound molecules dissociate, then the test antibody is a candidate for an antibody against an epitope overlapping with the epitope bound by the multispecific antigen-binding molecule of the present invention. This will enable efficient screening of novel multispecific antigen-binding molecules.

The combinations presented as examples herein as combinations of each CDR of the multispecific antigen-binding molecules of the present invention can be directly used as specific combinations of CDRs of the H-chain and L-chain variable regions in these molecules. The antigen affinity of these molecules (KD values) is preferably a value exemplified herein as the KD value of a multispecific antigen-binding molecule of the present invention, but is not limited thereto.

In the present invention, the indefinite article "a" or "an" refers to one, or two or more (i.e., at least one) grammatical object referred to by the indefinite article. For example, "a component" refers to one component or two or more components.

Those skilled in the art will naturally appreciate that any combinations of one or more of the embodiments described herein are also included in the present invention as long as they are not technically inconsistent based on common technical knowledge of those skilled in the art.

All prior art documents cited herein are incorporated by reference into this description.

EXAMPLES

Hereinbelow, the present invention will be specifically described with reference to the Examples, but it is not to be construed as being limited thereto.

[Example 1] T Cell-Dependent Cellular Cytotoxicity (TDCC Activity) of Each Test Antibody when Human Peripheral Blood Mononuclear Cells are Used as Effector Cells TDCC activity of each test antibody was measured by the method described below. Human peripheral blood mononuclear cells (hereinafter referred to as human PBMCs) were used as effector cells and TDCC activity of each test antibody was measured as follows.

(1) Preparation of Human PBMC Solution 50 ml of peripheral blood was collected from a healthy person in Chugai Pharmaceutical Co. Ltd. using a syringe pre-loaded with 500 µl of 5000 units/5 ml heparin solution. The peripheral blood diluted two-fold with PBS was divided into four aliquots and added to Leucosep tubes for lymphocyte separation (GE Healthcare) which had been loaded with 15 ml of Ficoll-Paque PLUS and centrifuged in advance. The separation tubes containing the aliquoted peripheral blood were centrifuged at a speed of 1000 g for 10 minutes at room temperature, and then, the mononuclear cell layer fraction was collected. After cells contained in each layer fraction were washed once with RPMI-1640 (SIGMA) containing 10% FBS (hereinafter referred to as 10% FBS/RPMI-1640), the cells were suspended at a cell density of $2 \times 10^6$ cells/ml in culture medium for each target cell. The cell suspensions were used as effector cells in subsequent experiments.

(2) LDH Release Test (TDCC Activity)

TDCC activity was assessed by an LDH release method (LDH Cytotoxicity Detection Kit, TAKARA). First, an antibody solution was diluted with each target cell culture medium to concentrations (0.000004, 0.00004, 0.0004, 0.004, 0.04, 0.4, 4, and 40 µg/ml), which were four times greater than the final concentrations, and 50-µl aliquots of antibody solutions of respective concentrations were added to each well of a ⅜-well round-bottomed plate. Then, 50-µl aliquots of target cells prepared at $2 \times 10^5$ cells/ml in culture medium for each target cell were seeded ($1 \times 10^4$ cells/well) and allowed to stand at room temperature for 15 minutes. 100-µl aliquots of the human PBMC suspension prepared in culture medium for each target cell ($2 \times 10^5$ cells/well) as described in (1) were added to each well of the plate. The plate was allowed to stand in a 5% carbon dioxide gas incubator at 37° C. for about 24 hours, followed by centrifugation. 100 µl of the culture supernatant in each well of the plate was transferred to a 96-well flat-bottomed plate. A catalyst solution was dissolved in 1 ml of $H_2O$ and mixed with a dye solution at ratio of 1:45. The mixed solution of catalyst and dye solutions was aliquoted at 100 µl/well to the 96-well flat-bottomed plate where the culture supernatants had been transferred. The plate was allowed to stand at room temperature for 15 to 30 minutes. The absorbance at 490 to 492 nm was measured with a plate reader. The reference wavelength used was 600 to 620 nm, and the absorbance was subtracted from that at 490 to 492 nm. Values obtained by subtracting the mean value for wells containing culture medium alone (blank) were plugged into the following equation.

$$\text{Cytotoxicity (TDCC)(\%)} = ((A-B)-C))\times 100/(D-C) \quad \text{Equation:}$$

Cytotoxic activity was determined based on this equation.

Here, A represents the absorbance of a mixture of target cells, effector cells, and antibody; B represents the absorbance of effector cells; C represents the absorbance of target cells; and D represents the absorbance of target cells with Triton X-100 added.

As a result, TDCC was clearly observed for an anti-human CD3ε chain and anti-human GPC3 bispecific antibody (the antibody of sample No. 38 described in Table 17 of Reference Example 3) (FIG. 1).

[Example 2] Determination of the Amount of GPC3 Expressed on Cell Surface in Each Cell Line Antibody binding capacity (ABC) of GPC3 on cell surface was calculated for each cell line by flow cytometry using QIFIKIT (DAKO).

After washing with CellWASH (BD Bioscience) supplemented with 0.5% BSA (hereinafter referred to as FACS/PBS), $5 \times 10^5$ cells of each cell line were prepared in 50 µl of a solution containing mouse anti-human GPC antibody or control antibody at a final concentration of 20 µg/ml and allowed to stand on ice for 30 minutes. The cells were washed with FACS/PBS. Then, 50 µl of a solution containing FITC-labeled goat anti-mouse IgG antibody which had been diluted 50-fold with FACS/PBS was added to the cells. The cells were allowed to stand on ice for 30 minutes. After washing with FACS/PBS, the cells were analyzed by flow cytometry. ABC was calculated by the method described in the instruction manual of QIFI KIT.

ABC of GPC3 on cell surface was calculated for each cell line and is shown in Table 6.

TABLE 6

| Cell name | Tissue | Histology | ABC |
|---|---|---|---|
| MKN-74 | Gastric | Adenocarcinoma | 2.97E3 |
| FU-97 | Gastric | Adenocarcinoma | 5.52E5 |
| SNU-1 | Gastric | Adenocarcinoma | 1.85E4 |
| STM-03 | Gastric | Adenocarcinoma | Not applicable (PDX) |
| SCC152 | Hypopharynx | Squamous carcinoma | 3.77E4 |
| KYSE70 | Esophageal | Squamous carcinoma | 5.35E4 |
| PC-10 | Lung | Squamous carcinoma | 1.21E5 |
| NCI-H446 | Lung | Small cell carcinoma | 6.95E4 |
| huH-1 | Liver | Carcinoma | 5.66E4 |
| HuH-7 | Liver | Carcinoma | 4.85E4 |
| RMG-1 | Ovary | Adenocarcinoma | 3.00E2 |
| TOV-21G | Ovary | Clear cell adenocarcinoma | 1.15E4 |
| MDA-MB-134VI | Breast | Carcinoma, ductal carcinoma | 1.07E4 |
| HCC1419 | Breast | Carcinoma, ductal carcinoma | 1.76E4 |
| C2BBe1 | Colorectal | Adenocarcinoma | 5.77E4 |
| RCC-HB | Kidney | Adenocarcinoma, clear cell | 1.03E4 |
| WM-115 | Skin | Melanoma | 1.37E3 |
| VMRC-MELG | Skin | Melanoma | 1.58E3 |
| SJCRH30 | Striated muscle | Sarcoma | 9.26E3 |
| BxPC-3 | Pancreas | Adenocarcinoma | 1.06E3 |
| Shmac 4 | Prostate | Carcinoma | 3.46E3 |
| NTERA-2 | Testis | Teratocarcinoma | 7.60E3 |
| C-33 A | Uterine cervix | Carcinoma | 2.10E3 |

[Example 3] Evaluation of In Vivo Drug Efficacy (Anti-Human CD3ε Chain and Anti-Human GPC3 Bispecific Antibody) (Drug Efficacy Evaluation Studies when Antibodies of Sample Nos. 30, 31, 32, 33, and 38, or Antibodies of Sample Nos. 39 and 40 Described in Table 17 of Reference Example 3 are Used as a Single Agent)

In vivo drug efficacy was evaluated using tumor-bearing models of some of the lines in which cytotoxic activity was observed by the in vitro assay described in Example 1 as well as in vivo-passaged lines.

Methods called an NOD scid/T cell-injected model, a humanized NOG mouse model, and a human CD3εδγ gene-modified mouse model were used in the in vivo drug efficacy evaluation. Assay using an NOD scid/T cell-injected model was performed as follows. Some of the lines in which cytotoxic activity was observed in the in vitro assay and in vivo-passaged cell lines were transplanted into NOD scid mice. T cells expanded by culturing human PBMCs in vitro were injected into the NOD scid mice with confirmed tumor establishment. The mice were treated by administering bispecific antibody-38 and bispecific antibody-30, -31, -32, or -33. Assay using a humanized NOG mouse model was performed as follows. CD34-positive hematopoietic stem cells derived from umbilical cord blood were transplanted into NOG mice by tail vein injection. Human T cells are constantly supplied in the mice, which are called humanized NOG mice. The PC-10 cell line was transplanted into humanized NOG mice. The humanized NOG mice with confirmed establishment of PC-10 tumor were treated by administering antibody-38. Assay using a human CD3εδγ gene-modified mouse model was performed as follows. Cells of mouse-derived cell line forced to express human GPC3 were transplanted into a human CD3εδγ gene-modified mouse model, which had been prepared according to Reference Example 10. The human CD3εδγ gene-modified mice with confirmed tumor establishment were treated by administering antibody-38.

The drug efficacy evaluation studies for bispecific antibody-38, and bispecific antibody-30, -31, -32, and -33 in NOD scid/T cell-injected model were performed as follows. T cell expansion culture was performed using PBMCs separated from blood collected from a healthy person and T cell activation/expansion kit/human. Each of human cancer cell lines (MKN74, FU-97, SNU-1, SCC152, KYSE70, PC-10, HuH-7, TOV-21G, RMG-1, and SK-pca31a (SK-HEP-1/hGPC3)) was mixed with Matrigel™ Basement Membrane Matrix, and transplanted subcutaneously into NOD scid mice (CLEA Japan). An in vivo-passaged line (STM-03) was transplanted as about 2-mm tumor tissue cubes subcutaneously into NOD scid mice (CLEA Japan). The day of transplantation was defined as Day 0. On the day before transplantation, anti-asialo GM1 antibody (Wako Pure Chemical Industries) was administered intraperitoneally at 0.2 mg/mouse. When tumor was clearly established after transplantation, the mice were separated into groups based on tumor size and body weight. Then, anti-asialo GM1 antibody was administered intraperitoneally at 0.2 mg/mouse again. On the following day, T cells obtained by the aforementioned expansion culture were transplanted intraperitoneally at $1.5 \times 10^7$ to $3 \times 10^7$ cells/mouse. About two to five hours after T cell transplantation, antibody-38 was administered at 1 mg/kg (MKN74, FU-97, SNU-1, SCC152, KYSE70, PC-10, HuH-7, TOV-21G, RMG-1, and STM-03) through the tail vein. The administration was performed only once. Bispecific antibody-30, -31, -32, and -33 were administered at 5 mg/kg (SK-pca31a) through the tail vein. The administration was performed only once.

Bispecific antibody-39 and -40 were administered at 1 mg/kg (PC-10) through the tail vein. The administration was performed only once. Antibody-39 and -40 used in the experiment have different constant region sequences, but they share the same amino acid sequences of the CD3-binding variable region, GPC3-binding variable region, and common L chain variable region (CD3-binding variable region: SEQ ID NO: 433, GPC-binding variable region: SEQ ID NO: 434, common L chain variable region: SEQ ID NO: 435). The antibodies were produced by a method known to those skilled in the art.

As a result, bispecific antibody-38 produced an evident anti-tumor effect as compared to the vehicle-administered group (FIG. 2).

Figure 3:
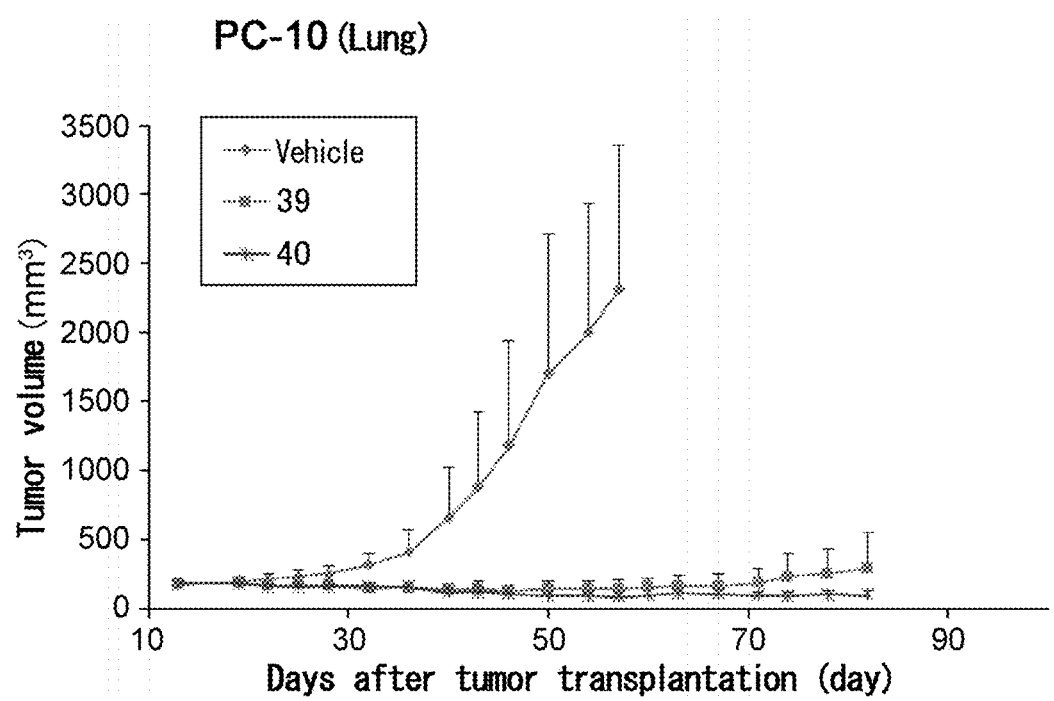
FIG. 3 is a graph showing the anti-tumor activities of antibody-39 and -40 against PC-10 xenograft tumor in a human T cell transplantation model.

As a result, bispecific antibody-39 and -40 produced an evident anti-tumor effect as compared to the vehicle-administered group (FIG. 3).

Figure 4:
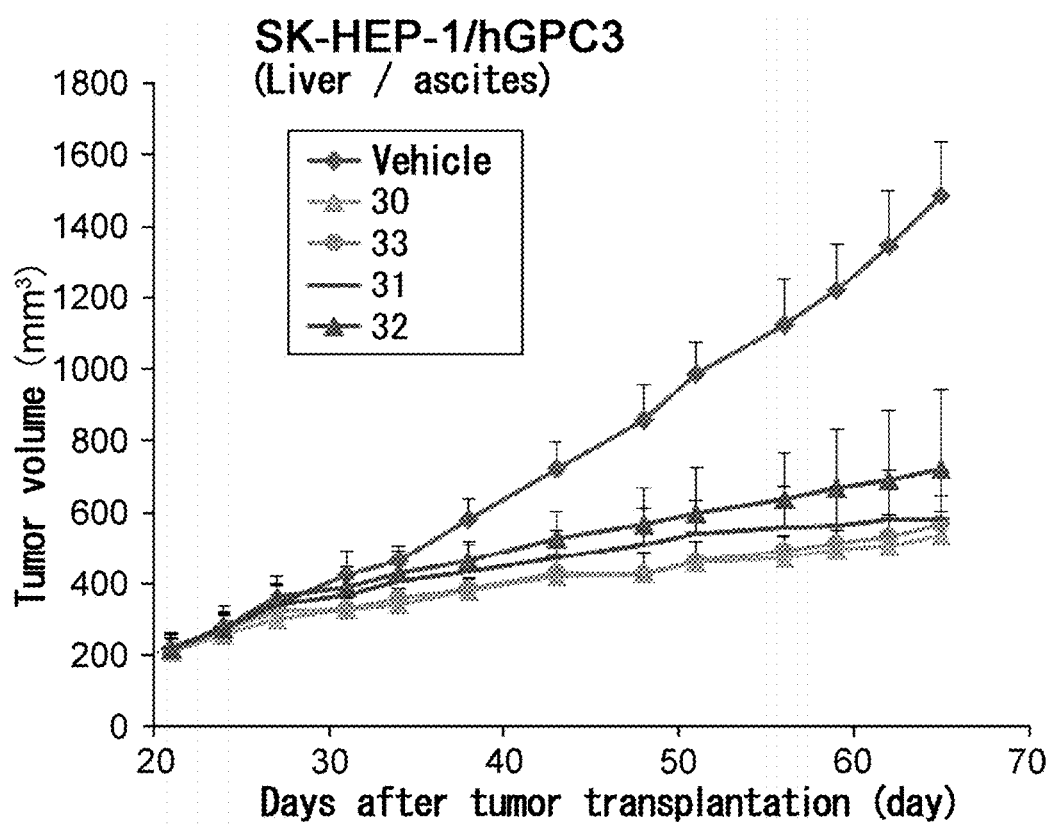
FIG. 4 is a graph showing the anti-tumor activities of antibody-30, -31, -32, and -33 against SK-HEP-1/hGPC3 (SK-pca31a) xenograft tumor in a human T cell transplantation model.

As a result, bispecific antibody-30, -31, -32, and -33 produced an evident anti-tumor effect as compared to the vehicle-administered group (FIG. 4).

The drug efficacy evaluation study for antibody-38 in the humanized NOG mouse model was performed as follows. 2.5 Gy of X ray was irradiated to NOG mice (In-Vivo Science Inc., ♀). On the following day, $1 \times 10^5$ CD34-positive hematopoietic stem cells which are derived from umbilical cord blood were transplanted to the NOG mice by tail vein injection. After 16 weeks, human PC-10 cancer cells were mixed with Matrigel™ Basement Membrane Matrix, and transplanted subcutaneously into the humanized NOG mice. The day of transplantation was defined as Day 0. When tumor was clearly established, the mice were separated into groups based on tumor size and body weight. Antibody-38 was administered at 0.008, 0.04, 0.2, or 1 mg/kg through the tail vein. Antibody-38 was administered only once.

Figure 5:
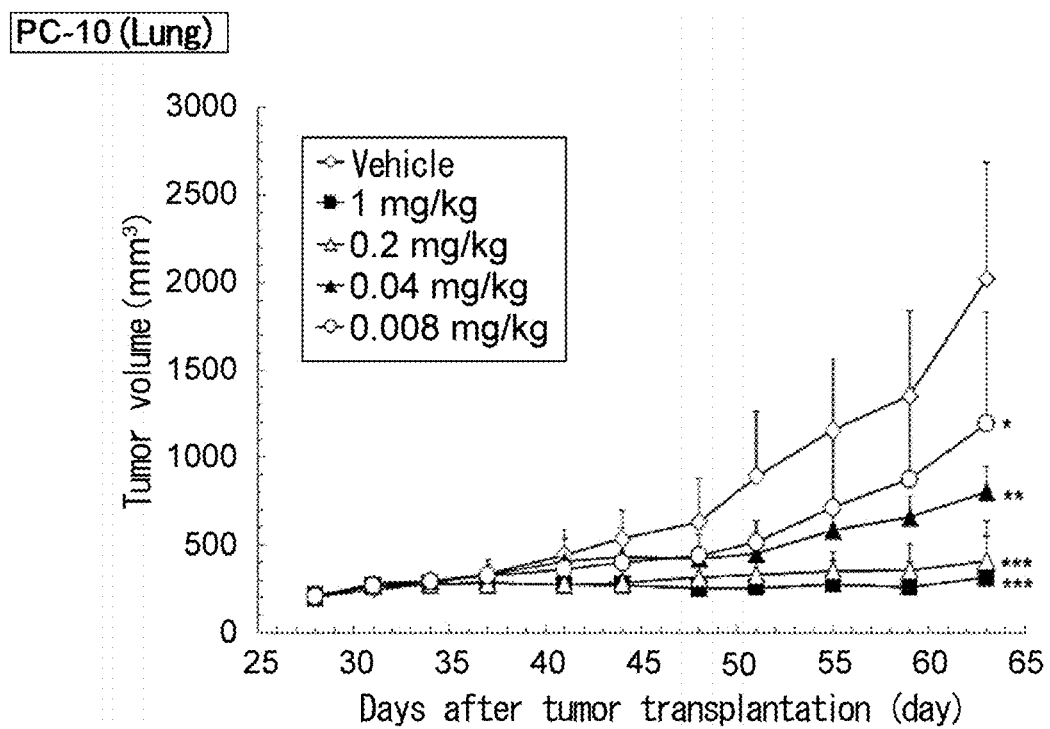
FIG. 5 is a graph showing the anti-tumor activity of antibody-38 against PC-10 xenograft tumor in a humanized NOG mouse model.

As a result, an evident, dose-dependent anti-tumor effect was produced in the antibody-38-administered group as compared to the vehicle-administered group (FIG. 5).

The drug efficacy evaluation study for antibody-38 in assay using a human CD3εδγ gene-modified mouse model was performed as follows. LLC1/hGPC3 cancer cells, which are mouse-derived cancer cell line with over-expression of human GPC3, were transplanted subcutaneously into human CD3εδγ gene-modified mice (Chugai Pharmaceutical Co. Ltd., ♀). The day of transplantation was defined as Day 0. On Day 11, the mice were separated into groups based on tumor size and body weight. Antibody-38 was administered at 5 mg/kg through the tail vein. Antibody-38 was administered twice (Day 11 and Day 14). An anti-human GPC3 antibody (WO2006/006693, clone name: GC33), anti-mouse CTLA-4 antibody (BioXCell, Catalog #BE0032), anti-mouse PD-1 antibody (BioXCell, Catalog #BE0146), and anti-mouse PD-L1 antibody (BioXCell, Catalog #BE0101), which were pharmaceutical agents used as controls, were administered at 25 mg/kg through the tail vein. The anti-human GPC3 antibody, anti-mouse CTLA-4 antibody, anti-mouse PD-1 antibody, and anti-mouse PD-L1 antibody were administered twice (Day 11 and Day 14).

Figure 6:
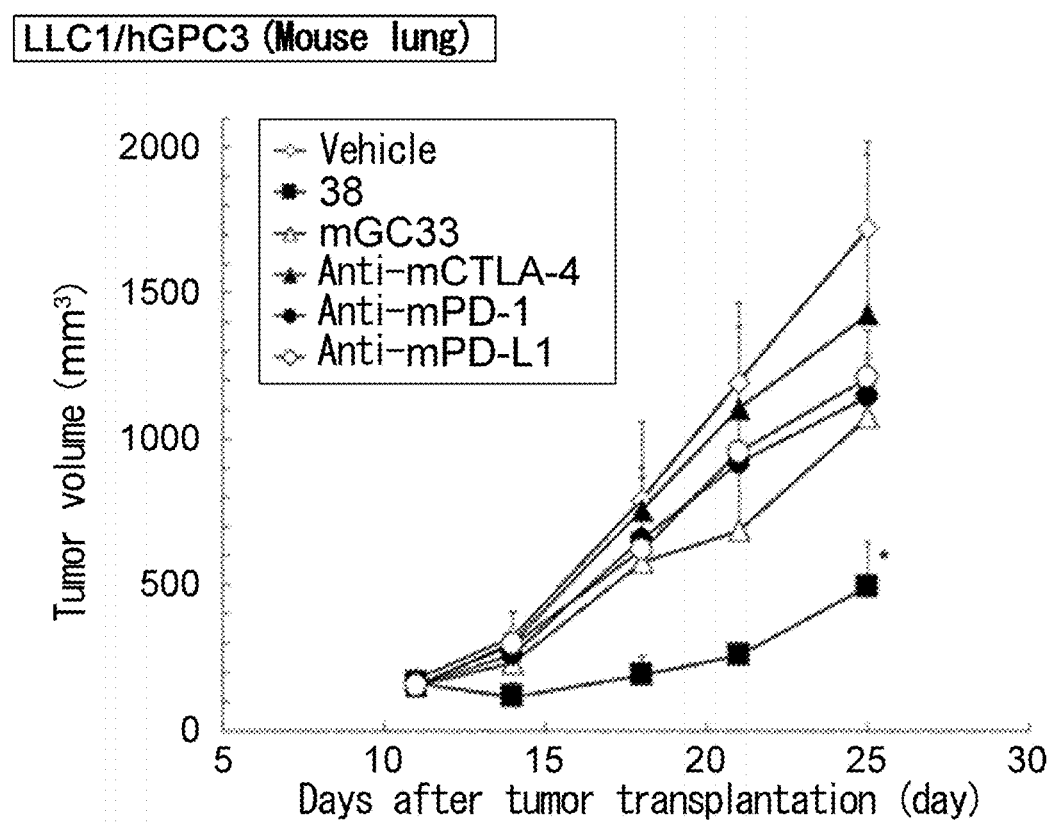
FIG. 6 is a graph showing the anti-tumor activities of antibody-38, and anti-human GPC3 antibody, anti-mouse CTLA-4 antibody, anti-mouse PD-1 antibody, or anti-mouse PD-L1 antibody against LLC1/hGPC3 syngeneic tumor in a human CD3εδγ gene-modified mouse model.

As a result, antibody-38 produced an evident anti-tumor effect as compared to the solvent-administered group, or the anti-human GPC3 antibody, anti-mouse CTLA-4 antibody, anti-mouse PD-1 antibody, and anti-mouse PD-L1 antibody (FIG. 6).

[Example 4] Evaluation of In Vivo Drug Efficacy (Drug Efficacy Evaluation Study for Combination of Antibody-38 and Other Agents)

In vivo drug efficacy evaluation study for combination of antibody-38 and other agents was carried out using tumor-bearing models. In vivo drug efficacy by the combination was evaluated using the NOD scid/T cell-injected model described in Example 3, the human CD3εδγ gene-modified mouse model described in Example 3, or a human CD3ε gene-modified mouse model. Combination study using the NOD scid/T cell-injected model was performed as follows. MKN45 or NCI-H446 cell line was transplanted into NOD scid mice. T cells expanded by culturing human PBMCs in vitro were injected into the NOD scid mice with confirmed evident tumor establishment. The mice were treated by administering antibody-38 in combination with capecitabine, cisplatin, or paclitaxel. Combination study using the human CD3εδγ gene-modified mouse model was performed as follows. LLC1/hGPC3 cancer cells or Hepa1-6/hGPC3 cells, which are mouse-derived cell lines forced to express human GPC3, were transplanted into human CD3εδγ gene-modified mice. The human CD3εδγ gene-modified mice with confirmed evident tumor establishment were treated by administering antibody-38 in combination with an anti-mouse TIM-3 antibody (BioXCell, Catalog #BE0115), anti-mouse LAG-3 antibody (BioXCell, Catalog #BE0174), anti-mouse CD137 antibody (BioXCell, Catalog #BE0169), or anti-mouse VEGFR2 antibody (BioXCell, Catalog #BP0060). Combination study using a human CD3ε gene-modified mouse model was performed as follows. Hepa1-6/hGPC3 cancer cells, which are a mouse-derived cancer line forced to express human GPC3, were transplanted into human CD3ε gene-modified mice. The human CD3ε gene-modified mice with confirmed evident tumor establishment were treated by administering antibody-38 in combination with an anti-mouse PD-1 antibody (BioXCell, Catalog #BE0146) or anti-mouse PD-L1 (BioXCell, Catalog #BE0101) antibody.

The drug efficacy evaluation study for antibody-38 and other agents using the NOD scid/T cell-injected model was performed as follows. T cell expansion culture was performed using PBMCs separated from blood collected from a healthy person and T cell activation/expansion kit/human. Each of human cancer cell lines (MKN45 and NCI-H446) was mixed with Matrigel™ Basement Membrane Matrix, and transplanted subcutaneously into NOD scid mice (CLEA Japan). The day of transplantation was defined as Day 0. On the day before transplantation, anti-asialo GM1 antibody was administered intraperitoneally at 0.2 mg/mouse. When evident tumor establishment was confirmed after transplantation, the mice were separated into groups based on tumor size and body weight. Then, anti-asialo GM1 antibody was administered intraperitoneally at 0.2 mg/mouse again. On the following day, T cells obtained by the aforementioned expansion culture were transplanted intraperitoneally at $3\times10^7$ cells/mouse. About two to five hours after T cell transplantation, antibody-38 was administered. In combination with antibody-38, capecitabine, cisplatin, or paclitaxel was administered according to the dose and dosing regimen shown in Table 7.

TABLE 7

| Cell line | Pharmaceutical agent for use in combination | Pharmaceutical agent for use in combination Dose and administration route | Pharmaceutical agent for use in combination Dosing regimen | Antibody-38 Dose | Antibody-38 Dosing regimen |
|---|---|---|---|---|---|
| MKN45 | capecitabine | 431 mg/kg Oral administration | Repetive administration for five days from Day 17 | 5 mg/kg, Tail vein administration | Single administration Day 14 |
| | cisplatin | 7.5 mg/kg Tail vein administration | Single administration Day 13 | 1 mg/kg, Tail vein administration | Single administration Day 14 |
| | paclitaxel | 20 mg/kg Tail vein administration | Single administration Day 13 | 1 mg/kg, Tail vein administration | Single administration Day 14 |
| NCI-H446 | cisplatin | 7.5 mg/kg Tail vein administration | Single administration Day 14 | 1 mg/kg, Tail vein administration | Single administration Day 15 |
| | paclitaxel | 20 mg/kg Tail vein administration | Days 14 and 21 | 1 mg/kg, Tail vein administration | Single administration Day 15 |

Figure 8:
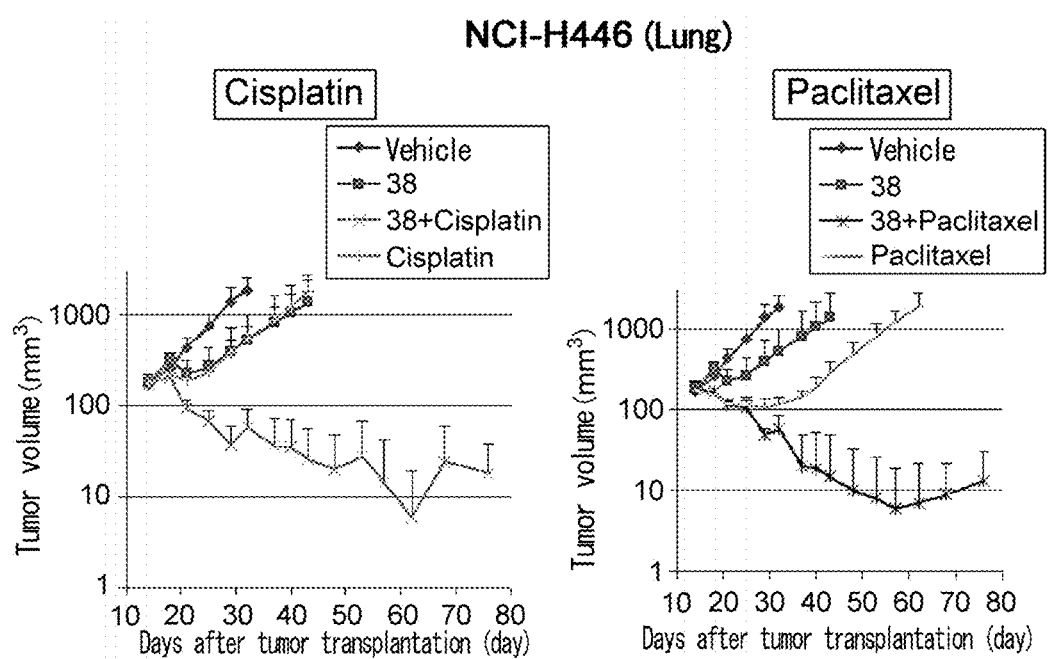
FIG. 8 is graphs showing the anti-tumor activities resulting from a single or combination of antibody, and cisplatin or paclitaxel against NCI-H446 xenograft tumor in a human T cell transplantation model.

As a result, the anti-tumor effect was enhanced in the combination groups to which antibody-38 and the pharmaceutical agent for use in combination were administered as compared to groups where antibody-38 or the pharmaceutical agent for use in combination was used alone (FIGS. 7 and 8).

RNA was extracted from tumor samples after administration of paclitaxel, cisplatin, or capecitabine and antibody-38. Comprehensive RNA analysis using nCounter, tumor infiltrating lymphocyte (TIL) analysis, and pathological analysis were performed as follows.

The tumor samples were prepared as follows. The tumor samples when antibody-38 was used in combination with a chemotherapeutic agent in the humanized NOG mouse model were prepared by the procedure described below. 2.5 Gy of X ray was irradiated to NOG mice (In-Vivo Science Inc., ♀). On the following day, $1 \times 10^5$ CD34-positive hematopoietic stem cells which are derived from umbilical cord blood were transplanted into the NOG mice by tail vein injection. After 16 to 20 weeks, each of human cancer cell lines (MKN45 and NCI-H446) was mixed with Matrigel™ Basement Membrane Matrix, and transplanted subcutaneously into the humanized NOG mice. The day of transplantation was defined as Day 0.

When tumor was established, the mice were separated into groups based on tumor size and body weight. Antibody-38 and the pharmaceutical agents for use in combination were administered according to the dose and dosing regimen described in Table 21. The mice were euthanized at the timing described in Table 21, and tumor was excised and preserved for use in tumor infiltrating lymphocyte (TIL) analysis, pathological analysis, or RNA analysis.

RNA analysis was performed as follows. RNA was extracted (miRNeasy Mini Kit, QIAGEN) from the above-described tumor samples and the RNA concentrations were determined (NanoDrop, Thermo Fisher Scientific). 100 ng of RNA was subjected to comprehensive (human) RNA expression analysis using nCounter PanCancer Pathway Panel and PanCancer Immune Profiling Panel (NanoStrng). Normalization was performed using the housekeeping gene included in the Panel. The analysis software used was nSolver (NanoStrng).

As a result, the expressions of immune cell markers, chemokines, cytokines, genes involved in cell death, genes involved in cell cycle regulation were increased and the expressions of genes involved in the progress of cell cycle were suppressed when antibody-38 was used in combination with a chemotherapeutic agent, paclitaxel or capecitabine, as compared to the group to which antibody-38 or the chemotherapeutic agent was administered alone (FIG. 35-1 to 35-6).

TIL analysis was performed as follows. Tumor tissues which were dissected from mice transplanted with NCI-H446 described in Table 21 on the sixth day after antibody-38 administration were dissociated into cells by enzyme treatment using gentle MACS™ Octo Dissociator. The cells were labeled with CD45, CD3, CD4, CD8, and GZMB antibodies and examined for their positive rates in each fraction of TIL using BD LSRFortessa X-20.

Figure 36A:
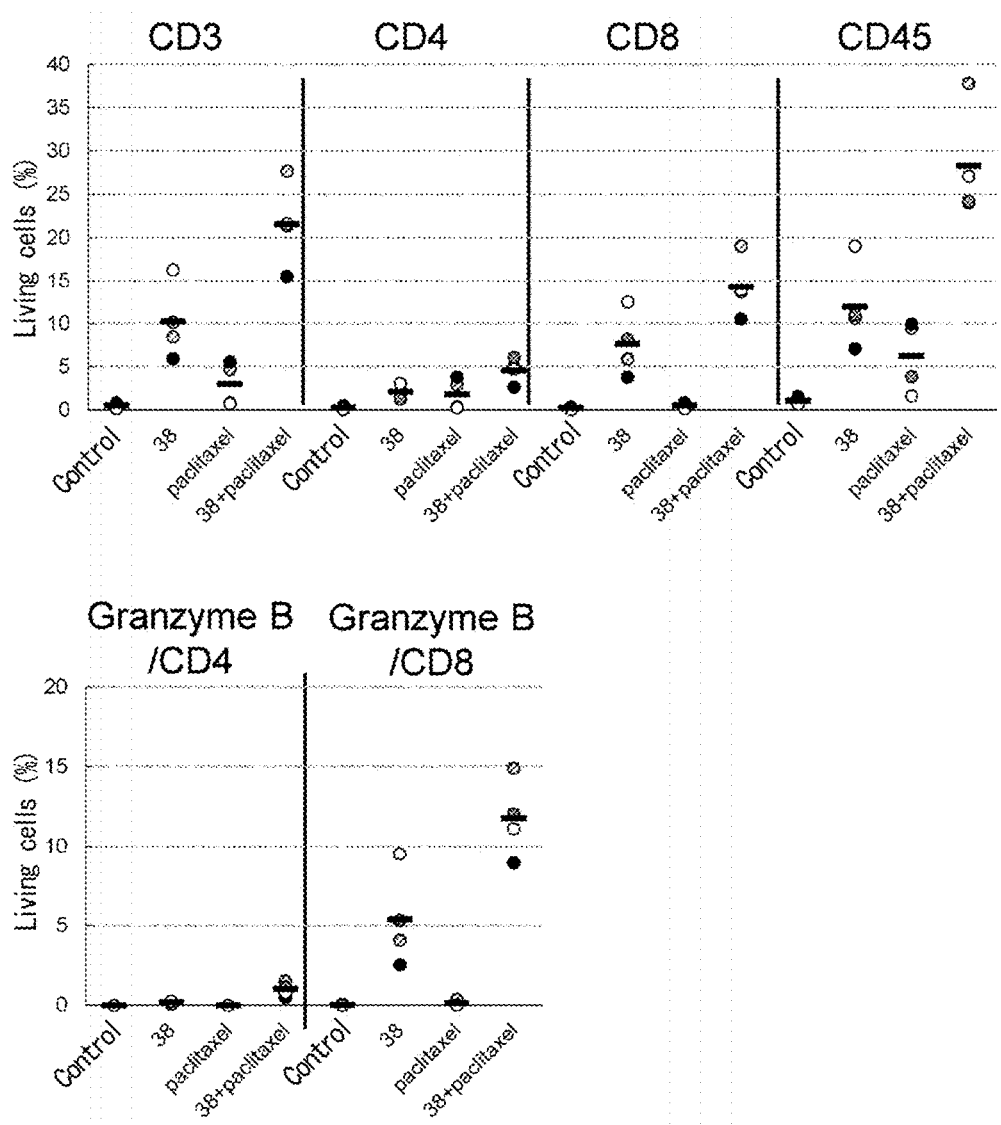
FIG. 36A shows a result of tumor infiltrating lymphocyte (TIL) analysis of tumor tissues when Paclitaxel and antibody-38 are used in combination.
Figure 36B:
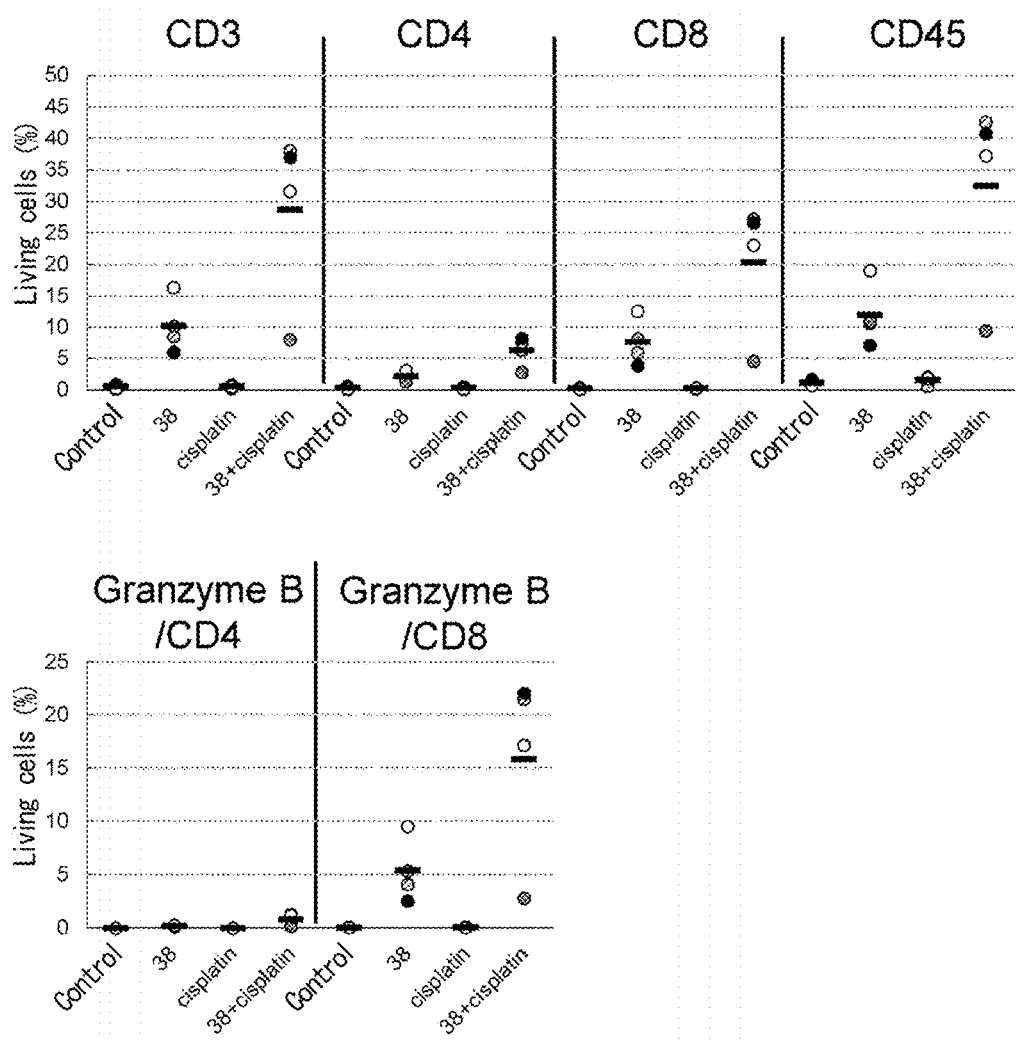
FIG. 36B shows a result of tumor infiltrating lymphocyte (TIL) analysis of tumor tissues when Cisplatin and antibody-38 are used in combination.

As a result, cell populations expressing T cell markers, activated T cell markers, and proteins involved in cytotoxic activity were increased when antibody-38 was used in combination with a chemotherapeutic agent, paclitaxel or capecitabine, as compared to the group to which antibody-38 or the chemotherapeutic agent was administered alone (FIGS. 36-1 and 36-2).

With respect to histological analysis of tumor tissues, tumor samples from mice six days after administration of antibody-38 and paclitaxel were fixed in 10% formaldehyde neutral buffer solution. Then, HE-stained samples were prepared according to a conventional method, and histopathological evaluation was performed using a light microscope.

As a result, the immune cell infiltration was observed around the tumor periphery when antibody 38 was administered, and the infiltration area was expanded when antibody-38 was used in combination with paclitaxel.

The drug efficacy evaluation study for antibody-38 and other agents using the human CD3εδγ gene-modified mouse model was performed as follows. Hepa1-6/hGPC3 and LLC1/hGPC3 cancer cell lines, which are a mouse cancer cell line with over-expression of human GPC3, were transplanted subcutaneously into human CD3εδγ gene-modified mice (Chugai Pharmaceutical Co. Ltd.). The day of transplantation was defined as Day 0. When evident tumor establishment was confirmed, the mice were separated into groups based on tumor size and body weight. Treatment was performed by administering antibody-38 in combination with the anti-mouse TIM-3 antibody, anti-mouse LAG-3 antibody, anti-mouse CD137 antibody, or an-mouse VEGFR2 antibody. The dose of each pharmaceutical agent that was used in combination with antibody-38 is shown in Table 8.

TABLE 21

| Cell line | Pharmaceutical agent for use in combination | Pharmaceutical agent for use in combination Dose and administration route | Pharmaceutical agent for use in combination Dosing regimen | Antibody-38 Dose | Antibody-38 Dosing regimen | Tumor sampling | Analysis |
| --- | --- | --- | --- | --- | --- | --- | --- |
| MKN45 | capecitabine | 359 mg/kg Oral administration | Repetive administration for five days from Day 21 | 5 mg/kg Tail vein administration | Single administration Day22 | 14th day from the start of capecitabine administration | RNA |
| NCI-H446 | cisplatin | 7.5 mg/kg Tail vein administration | Single administration Day 20 | 5 mg/kg Tail vein administration | Single administration Day 21 | Sixth day after antibody-38 administration | TIL |
|  | paclitaxel | 20 mg/kg Tail vein administration | Single administration Day 20 | 5 mg/kg Tail vein administration | Single administration Day 21 | Sixth day after antibody-38 administration | TIL, RNA, Pathology |

TABLE 8

| Cell line | Model | Pharmaceutical agent for use in combination | Pharmaceutical agent for use in combination Dose and administration route | Pharmaceutical agent for use in combination Dosing regimen | Antibody-38 Dose | Antibody-38 Dosing regimen |
|---|---|---|---|---|---|---|
| Hepa1-6/hGPC3 | Human CD3εδγ gene-modified mouse | TIM3 Ab (Clone RMT 3-23) | 10 mg/kg Intravenous administration | Day 13 Single administration | 0.2 mg/kg, Tail vein administration | Day 13 Single administration |
| | | LAG-3 Ab (Clone C9B7W) | 10 mg/kg Tail vein administration | Day 13 Single administration | 0.2 mg/kg, Tail vein administration | Day 13 Single administration |
| | | CD137 Ab (Clone LOB12.3) | 10 mg/kg Tail vein administration | Day 13 Single administration | 0.2 mg/kg, Tail vein administration | Day 13 Single administration |
| | | VEGFR2 Ab (Clone DC101) | 10 mg/kg Tail vein administration | Day 13 Single administration | 0.2 mg/kg, Tail vein administration | Day 13 Single administration |
| LLC1/hGPC3 | Human CD3εδγ gene-modified mouse | CD137 Ab (Clone LOB12.3) | 10 mg/kg Intraperitoneal administration | Days 11 and 15 | 5 mg/kg, Tail vein administration | Days 11 and 15 |

Figure 9:
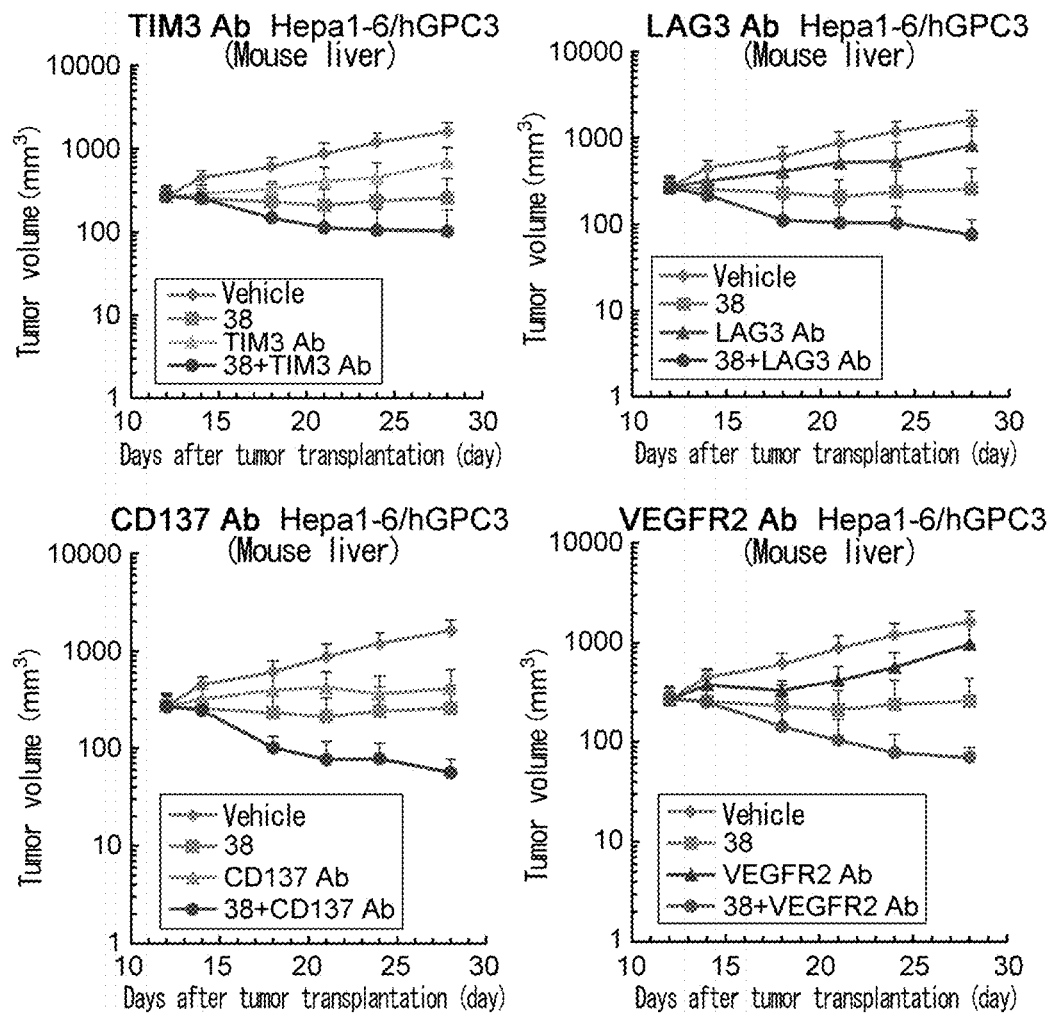
FIG. 9 is graphs showing the anti-tumor activities resulting from a single or combination of antibody-38, and anti-mouseTIM-3 antibody, anti-mouse LAG-3 antibody, anti-mouse CD137 antibody, or anti-mouse VEGFR2 antibody against Hepa1-6/hGPC3 syngeneic tumor in a human CD3εδγ gene-modified mouse model.
Figure 10:
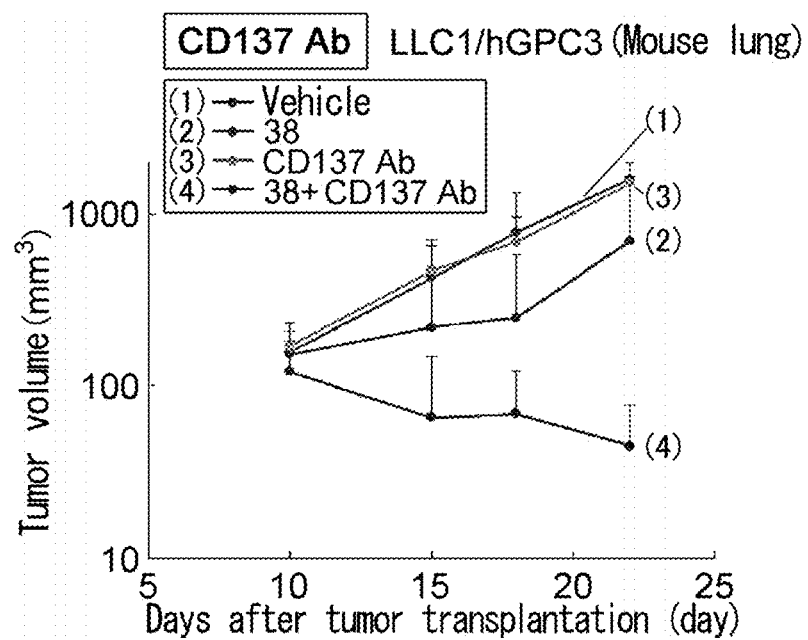
FIG. 10 is a graph showing the anti-tumor activities resulting from a single or combination of antibody-38 and anti-mouse CD137 antibody against LLC1/hGPC3 syngeneic tumor in a human CD3εδγ gene-modified mouse model.

As a result, the anti-tumor effect was enhanced in the combination groups to which antibody-38 and a pharmaceutical agent for use in combination were administered as compared to the groups where antibody-38 or the pharmaceutical agent for use in combination was used alone (FIGS. 9 and 10).

The drug efficacy evaluation study for antibody-38 with other agents in the human CD3ε gene-modified mouse model was performed as follows. Hepa1-6/hGPC3 cancer cell line, which is a mouse cancer cell line with over-expression of human GPC3, was transplanted subcutaneously into human CD3ε gene-modified mice (Chugai Pharmaceutical Co. Ltd.). The day of transplantation was defined as Day 0. On Day 15, the mice were separated into groups based on tumor size and body weight. Treatment was performed by administering antibody-38 in combination with the anti-mouse PD-1 antibody or anti-mouse PD-L1 antibody.

The dose of each pharmaceutical agent that was used in combination with antibody-38 is shown in Table 9.

REFERENCE EXAMPLES

[Reference Example 1] Production of GPC3_ERY22_rCE115 and Measurement of Cytotoxic Activity (1-1) Production of GPC3_ERY22_rCE115

A molecule in which one of the Fabs has been replaced with a CD3 epsilon-binding domain was produced using IgG against a cancer antigen (GPC3) as the basic structure. In this case, the IgG Fc used as the basic structure was a silent Fc with attenuated affinity for FcgR (an Fc□ (Fc gamma) receptor). An anti-GPC3 antibody, H0000 (SEQ ID NO: 40)/GL4 (SEQ ID NO: 41), was used as the GPC3-binding domain. An anti-CD3 antibody, rCE115H/rCE115L (SEQ ID NO: 42/SEQ ID NO: 43), was used as the CD3-binding domain.

G1d produced by removing Gly and Lys at the C terminus of IgG1 was used as the antibody H-chain constant region, and this was used in combination with H0000/GL4 and rCE115H/rCE115L. When the antibody H-chain constant region was named H1, the sequence corresponding to the H chain of the antibody carrying H0000 in the variable region

TABLE 9

| Cell line | Model | Pharmaceutical agent for use in combination | Pharmaceutical agent for use in combination Dose and administration route | Pharmaceutical agent for use in combination Dosing regimen | Antibody-38 Dose | Antibody-38 Dosing regimen |
|---|---|---|---|---|---|---|
| Hepa1-6/hGPG3 | Human CD3ε gene-modified mouse | PD-1 Ab (clone RMP1-14) | 200 μg/mouse Tail vein administration | Days 15 and 18 | 5 mg/kg, Tail vein administration | Days 15 and 18 |
| | | PD-L1 Ab (clone 10F.9G2) | 200 μg/mouse Tail vein administration | Days 15 and 18 | 5 mg/kg, Tail vein administration | Days 15 and 18 |

Figure 11:
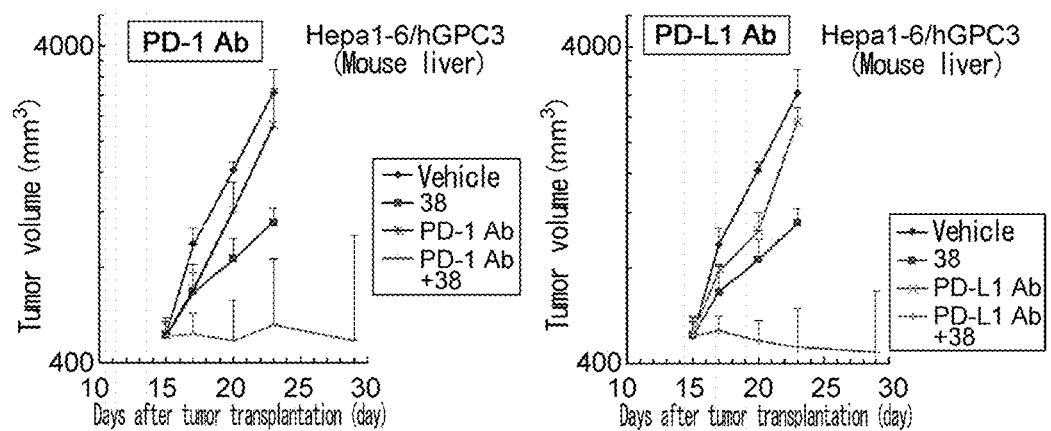
FIG. 11 is graphs showing the anti-tumor activities resulting from a single or combination of antibody-38, and anti-mouse PD-1 antibody or anti-mouse PD-L1 antibody against Hepa1-6/hGPC3 syngeneic tumor in a human CD3ε gene-modified mouse model.

As a result, the anti-tumor effect was enhanced in the combination groups to which antibody-38 and a pharmaceutical agent for use in combination were administered as compared to groups where antibody-38 or the pharmaceutical agent for use in combination was used alone (FIG. 11).

was shown as H0000-H1. Here, an amino acid alteration was shown, for example, as D356K. The first alphabet (corresponding to D in D356K) is the one-letter code representation for the amino acid residue before modification, the number that follows (corresponding to 356 of D356K) is the position of modification indicated by EU numbering, and the final alphabet (corresponding to K of D356K) is the one-letter code representation for the amino acid residue after modification. G1dh (SEQ ID NO: 44) produced by removing Gly and Lys at the C terminus of IgG1, ERY22_Hk (SEQ ID NO: 45) produced by introducing the L234A/L235A/Y349C/T366W mutations into G1dh, and ERY22_Hh (SEQ ID NO: 46) produced by introducing the L234A/L235A/D356C/T366S/L368A/Y407V mutations into G1dh were prepared according to the method of Reference Example 5. The L234A and L235A mutations were introduced into the respective H chains to attenuate affinity for FcgR (an Fc□ receptor), and the Y349C/T366W and D356C/T366S/L368A/Y407V mutations were introduced to efficiently form heteromers of each H chain when producing heterodimeric antibodies comprising two types of H chains.

The heterodimeric antibody, GPC3_ERY22_rCE115, produced by substitution with the VH and VL domains of Fab against GPC3 was prepared according to Reference Example 5 (FIG. 12a).

A series of expression vectors inserted with a polynucleotide encoding each of GL4-ERY22_Hk (SEQ ID NO: 47), H0000-ERY22_L (SEQ ID NO: 48), rCE115H-ERY22_Hh (SEQ ID NO: 49), and rCE115L-k0 (SEQ ID NO: 50) were produced by methods well-known to those skilled in the art, such as PCR methods using primers added with an appropriate sequence similar to those in the above-described method.

The following combination of expression vectors were introduced into FreeStyle 293-F cells for transient expression of each target molecule.

Target molecule: GPC3_ERY22_rCE115

Polypeptides encoded by the polynucleotides inserted into the expression vectors: GL4-ERY22_Hk, H0000-ERY22_L, rCE115H-ERY22_Hh, rCE115L-k0

(1-2) Purification of GPC3_ERY22_rCE115

The obtained culture supernatant was added to an anti-FLAG M2 column (Sigma), and then the column was washed, followed by elution using 0.1 mg/mL of a FLAG peptide (Sigma). The fractions containing the molecule of interest were added to a HisTrap HP column (GE Healthcare), and then the column was washed, followed by elution using an imidazole concentration gradient. Fractions containing the molecule of interest were concentrated using an ultrafiltration membrane, then the fractions were added to a Superdex 200 column (GE Healthcare), and each of the purified molecules of interest was obtained by collecting only the monomeric fractions from the eluted solution.

(1-3) Measurement of the Cytotoxic Activity of GPC3_ERY22_rCE115 Using Human Peripheral Blood Mononuclear Cells The in vitro cytotoxic activity of GPC3_ERY22_rCE115 was assessed.

(1-3-1) Preparation of a Human Peripheral Blood Mononuclear Cell (PBMC) Solution Using a syringe preloaded with 100 μL of 1,000 units/mL heparin solution (Novo Heparin for injection, 5000 units, Novo Nordisk), 50 mL of peripheral blood was collected from each healthy volunteer (adult individual). This peripheral blood was diluted two-fold in PBS(−), divided into four aliquots, and added into a Leucosep tube for lymphocyte separation (Cat. No. 227290, Greiner Bio-One) that had been loaded with 15 mL of Ficoll-Paque PLUS and subjected to centrifugation in advance. This separation tube was centrifuged (at 2150 rpm for ten minutes at room temperature), and then the mononuclear cell fraction was collected. The cells in the mononuclear cell fraction were washed once with the Dulbecco's Modified Eagle's Medium containing 10% FBS (manufactured by SIGMA, hereinafter referred to as 10% FBS/D-MEM), and then prepared to have a cell density of $4 \times 10^6$ cells/mL using 10% FBS/D-MEM. The cell suspension prepared this way was used as the human PBMC solution in the experiment below.

(1-3-2) Measurement of Cytotoxic Activity

Cytotoxic activity was assessed by the rate of cell proliferation inhibition using the xCELLigence Real-Time Cell Analyzer (Roche Diagnostics). The NCI-H446 human cancer cell line or the PC-10 human cancer cell line, which expresses human GPC3, was used as the target cell. NCI-H446 or PC-10 was detached from the dish, then the cells were plated into E-Plate 96 (Roche Diagnostics) in aliquots of 100 μL/well by adjusting the cells to $1 \times 10^4$ cells/well, and measurement of live cells was begun using the xCELLigence Real-Time Cell Analyzer. On the following day, the plate was removed from the xCELLigence Real-Time Cell Analyzer, and 50 μL of the respective antibodies prepared at each concentration (0.004, 0.04, 0.4, 4, or 40 nM) were added to the plate. After 15 minutes of reaction at room temperature, 50 μL of the human PBMC solution prepared in (1-2) was added ($2 \times 10^5$ cells/well), and measurement of live cells was begun by setting the plate into the xCELLigence Real-Time Cell Analyzer again. The reaction was carried out under the conditions of 5% carbon dioxide gas at 37° C., and from the Cell Index value obtained 72 hours after addition of the human PBMC, the cell proliferation inhibition rate (%) was determined using the equation below. The Cell Index value used in the calculation was a normalized value where the Cell Index value immediately before antibody addition was defined as 1.

Cell proliferation inhibition rate $(\%)=(A-B)\times 100/(A-1)$

A represents the mean value of the Cell Index values in wells without antibody addition (containing only the target cells and human PBMCs), and B represents the mean value of the Cell Index values in each well. The examinations were performed in triplicate.

Figure 13:
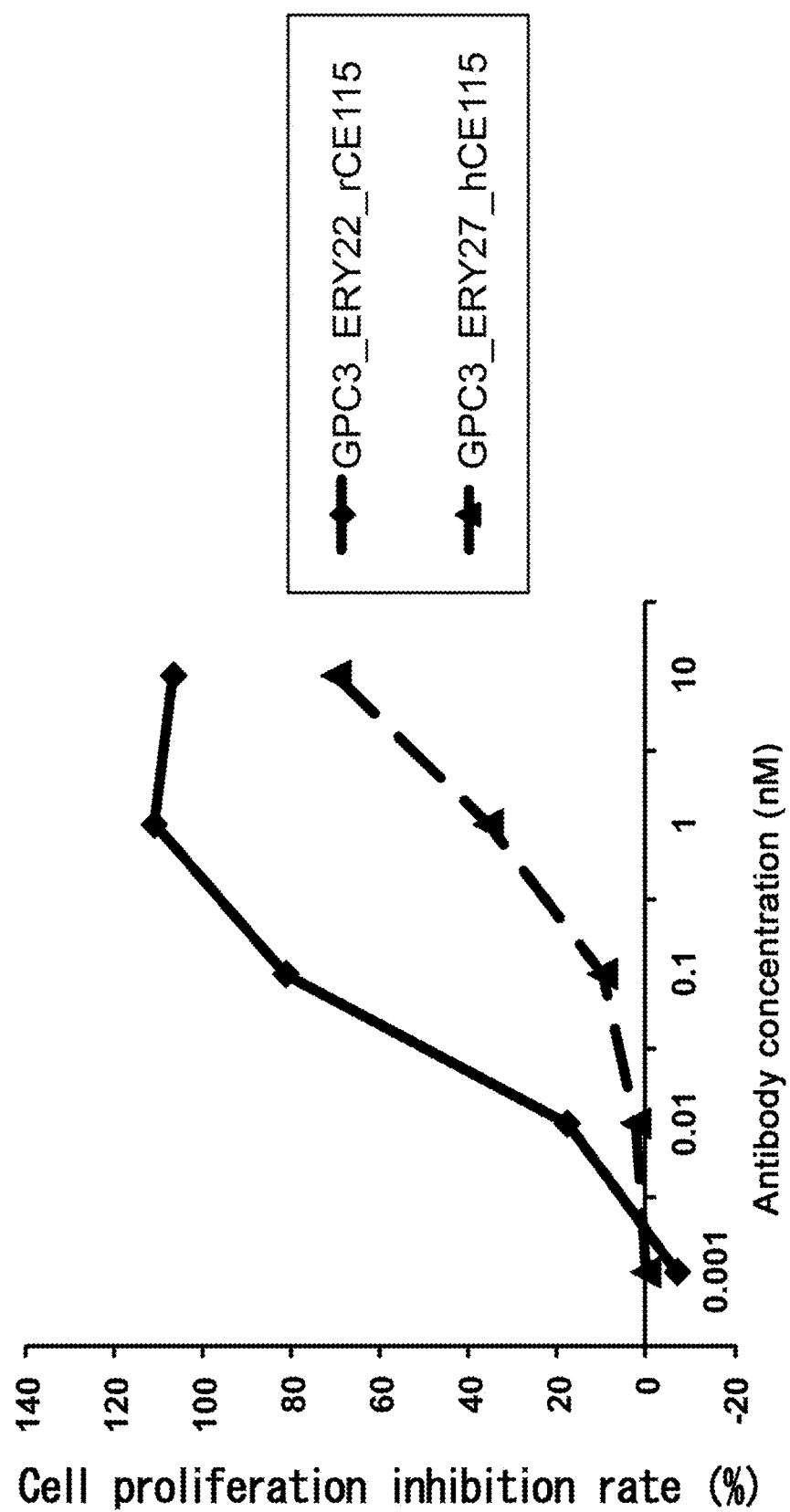
FIG. 13 is a graph showing the cytotoxic activities of GPC3_ERY22_rCE115 and GPC3_ERY27_hCE115 when NCI-H446 is used as the target cell. The filled diamond (◆) and the filled triangle (▲) indicate the cytotoxic activity of GPC3_ERY22_rCE115 and GPC3_ERY27_hCE115, respectively.
Figure 14:
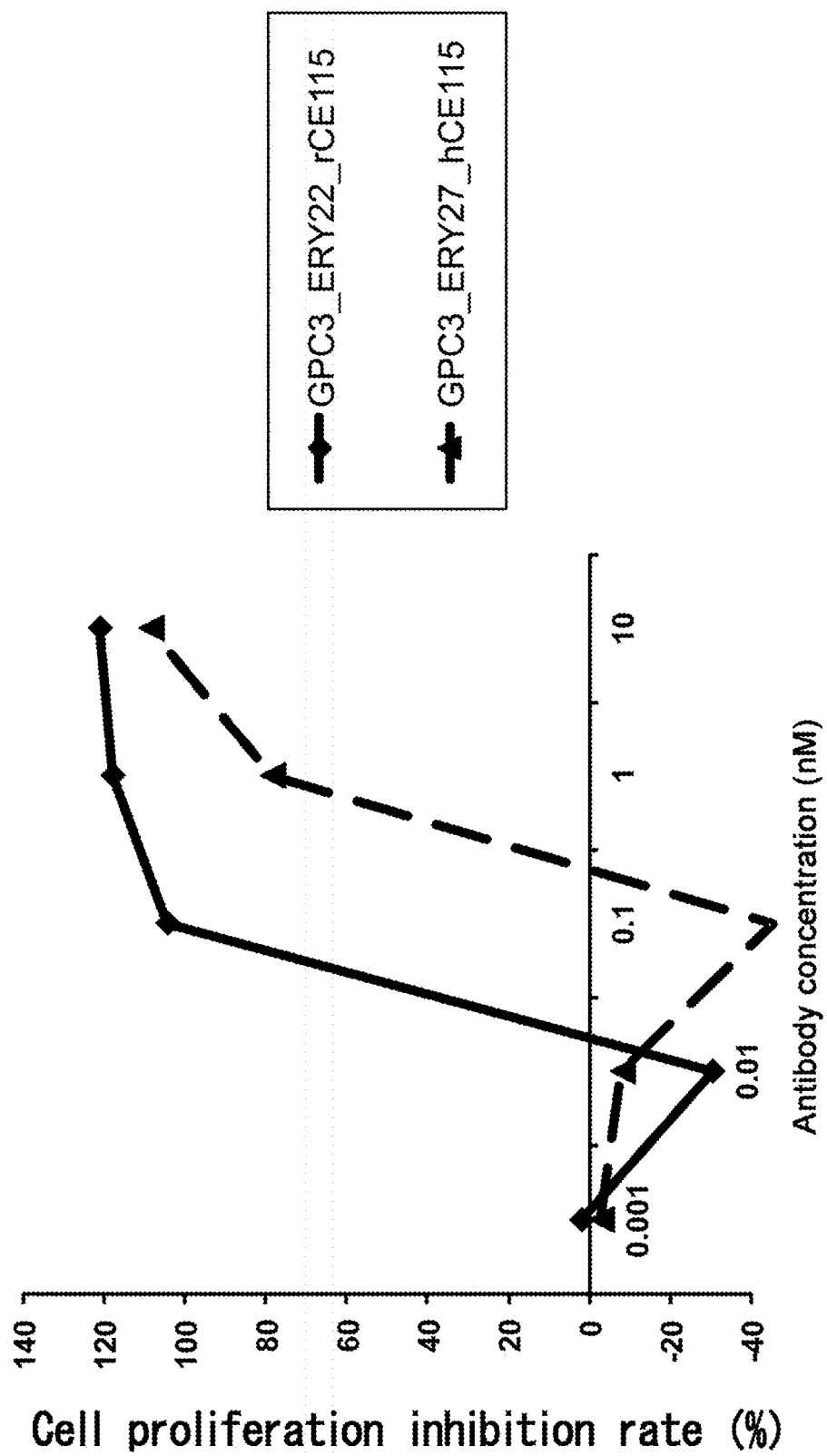
FIG. 14 is a graph showing the cytotoxic activities of GPC3_ERY22_rCE115 and GPC3_ERY27_hCE115 when PC-10 is used as the target cell. The filled diamond (◆) and the filled triangle (▲) indicate the cytotoxic activity of GPC3_ERY22_rCE115 and GPC3_ERY27_hCE115, respectively.
Figure 15:
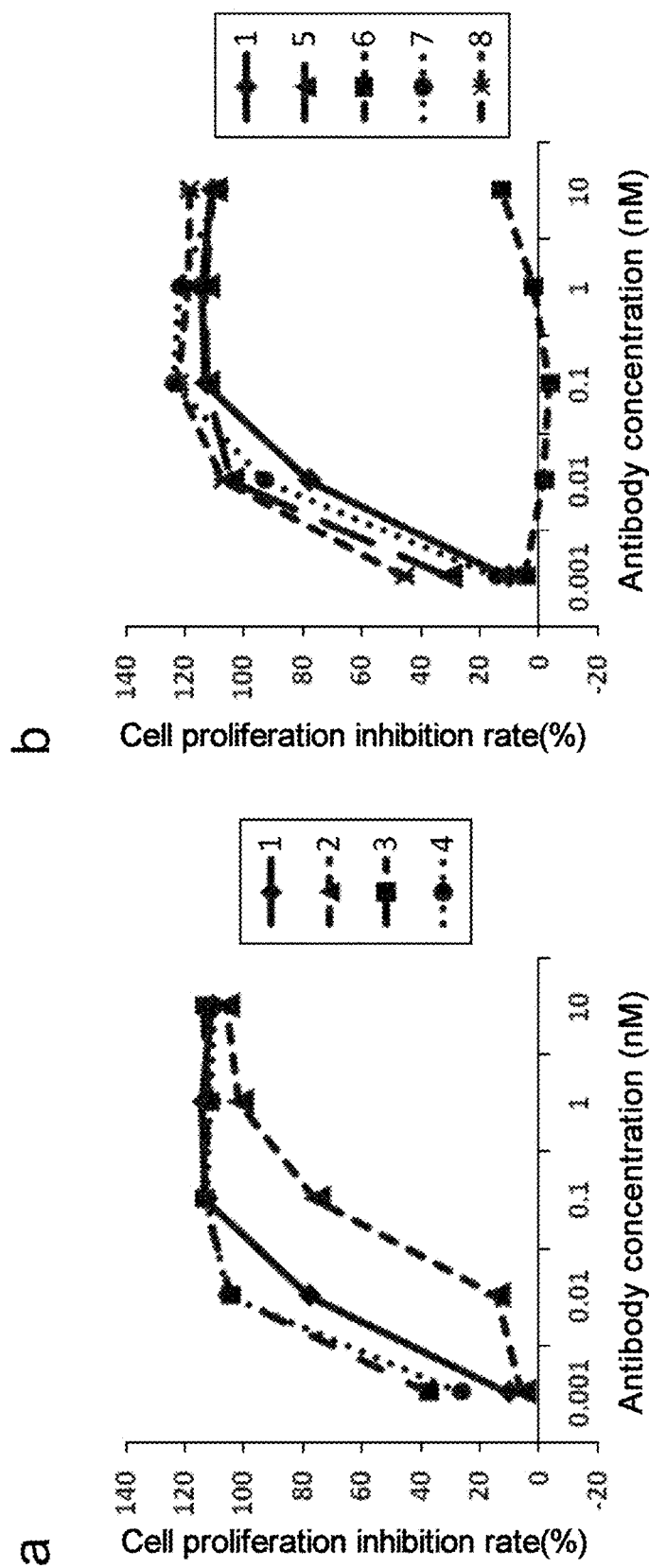
FIG. 15 is a graph showing the cytotoxic activities of optimized antibodies (a) 1, 2, 3 and 4, and (b) 1, 5, 6, 7 and 8 when NCI-H446 is used as the target cell. The optimized antibodies are described in Table 17.
Figure 16:
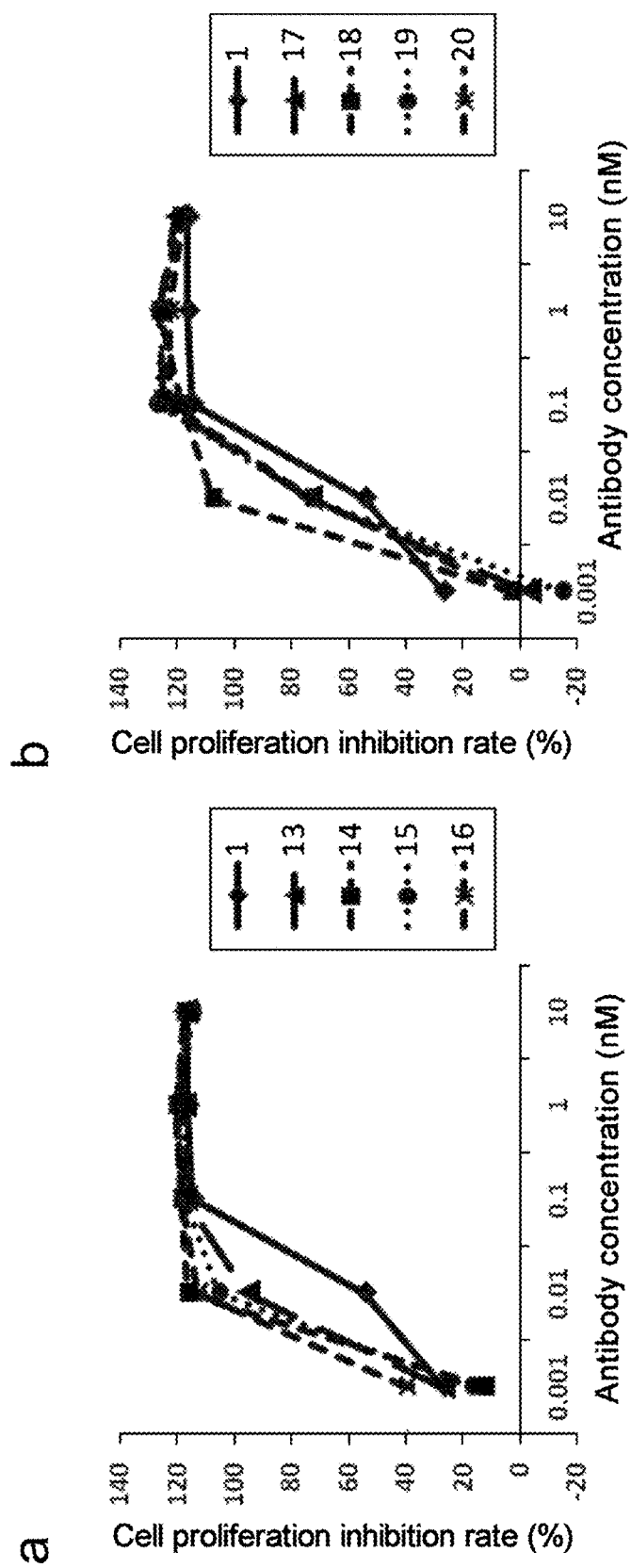
FIG. 16 is a graph showing the cytotoxic activities of optimized antibodies (a) 1, 13, 14, 15 and 16, and (b) 1, 17, 18, 19 and 20 when NCI-H446 is used as the target cell. The optimized antibodies are described in Table 17.
Figure 17:
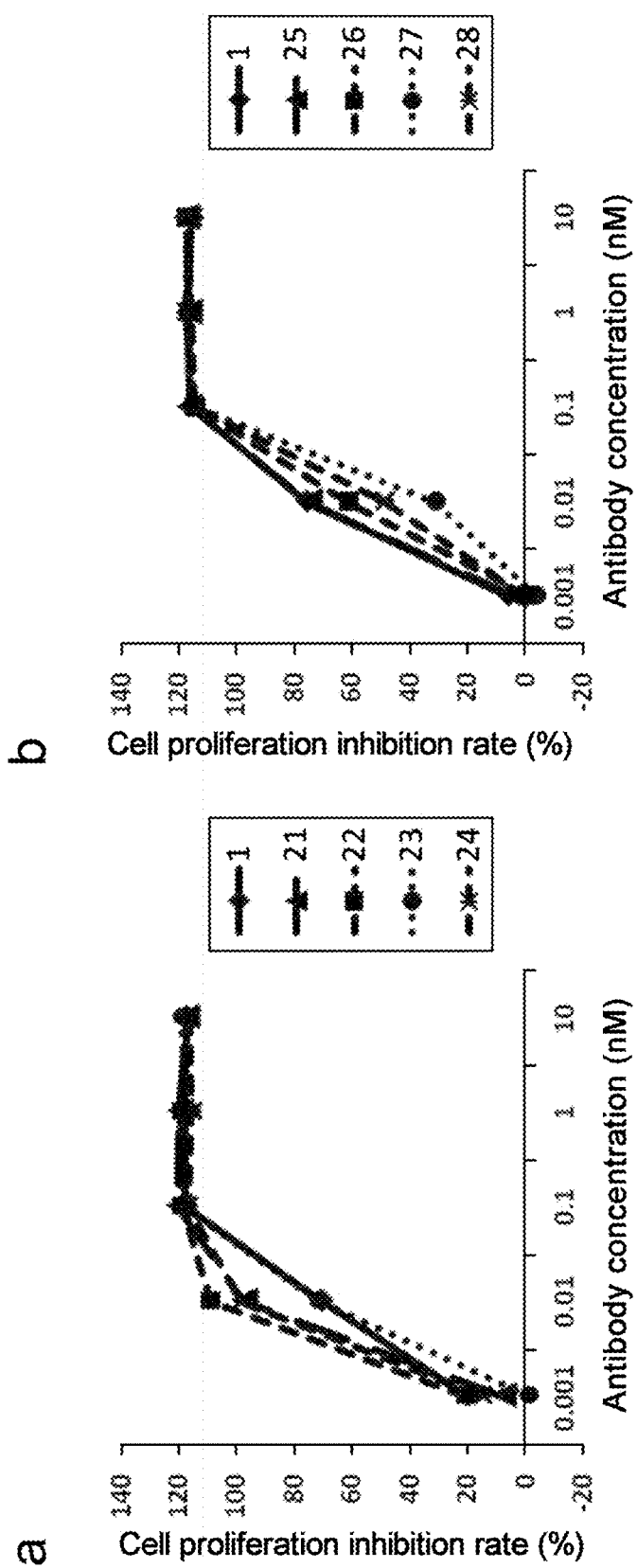
FIG. 17 is a graph showing the cytotoxic activities of optimized antibodies (a) 1, 21, 22, 23 and 24, and (b) 1, 25, 26, 27 and 28 when NCI-H446 is used as the target cell. The optimized antibodies are described in Table 17.
Figure 18:
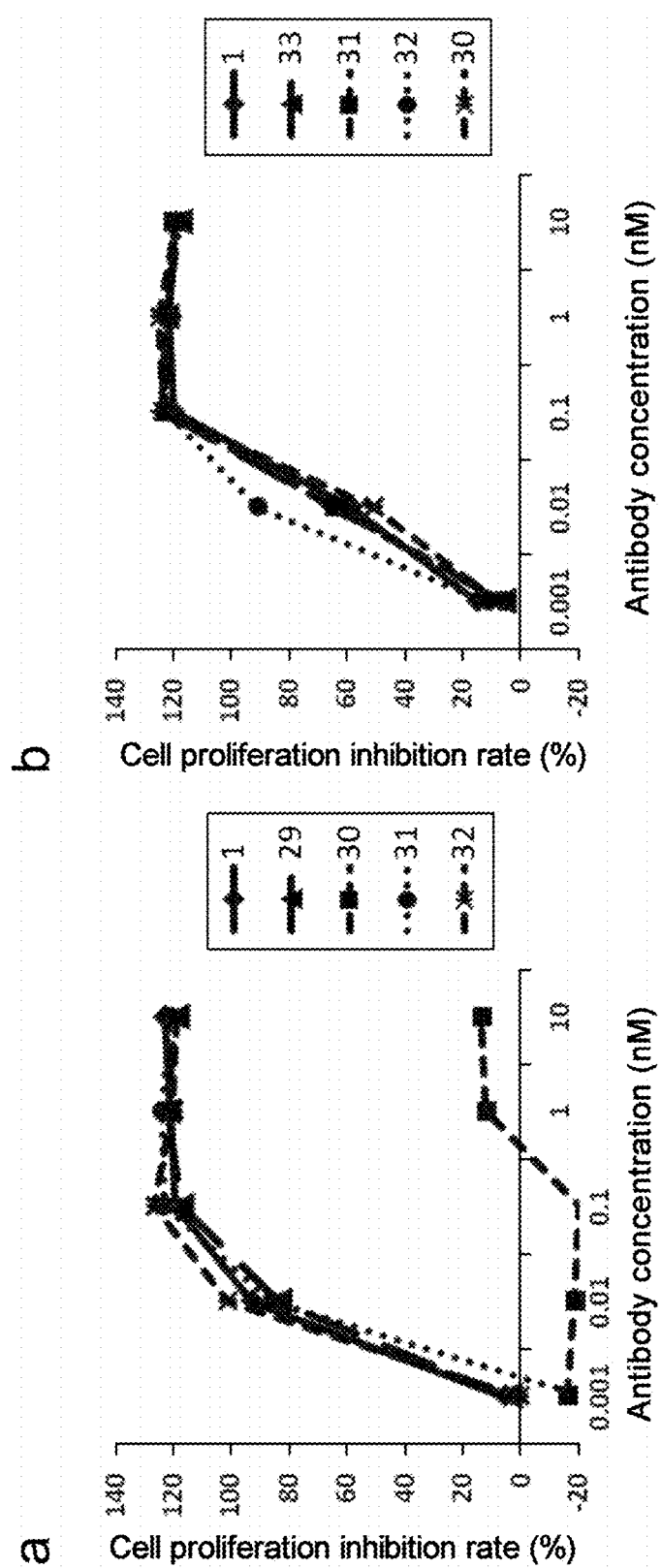
FIG. 18 is a graph showing the cytotoxic activities of optimized antibodies (a) 1, 29, 30, 31 and 32, and (b) 1, 33, 31, 32 and 30 when NCI-H446 is used as the target cell. The optimized antibodies are described in Table 17.
Figure 19:
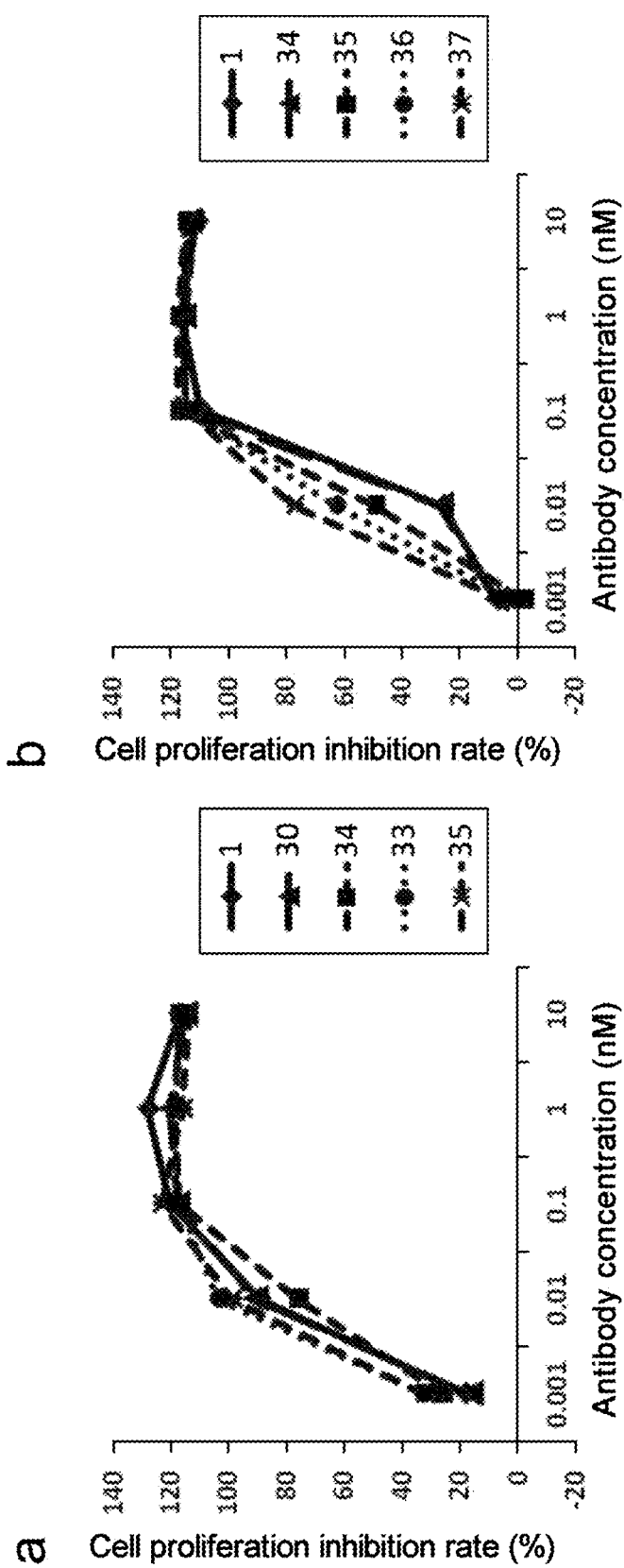
FIG. 19 is a graph showing the cytotoxic activities of optimized antibodies (a) 1, 30, 34, 33 an 35, and (b) 1, 34, 35, 36 and 37 when NCI-H446 is used as the target cell. The optimized antibodies are described in Table 17.
Figure 20:
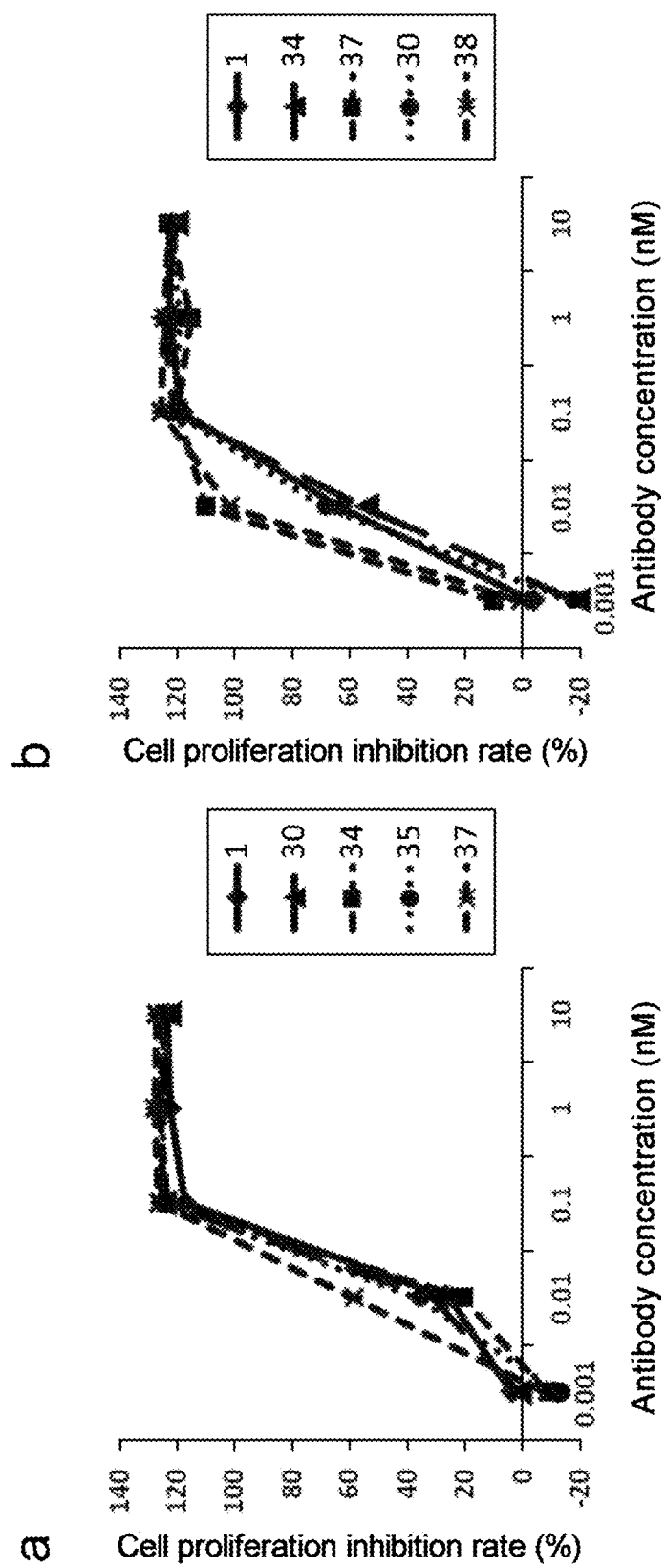
FIG. 20 is a graph showing the cytotoxic activities of optimized antibodies (a) 1, 30, 34, 35 and 37, and (b) 1, 34, 37, 30 and 38 when NCI-H446 is used as the target cell. The optimized antibodies are described in Table 17.

When peripheral blood mononuclear cells (PBMCs) prepared from human blood were used as the effector cell to measure the cytotoxicity of GPC3_ERY22_rCE115, a very strong activity was observed (FIG. 13).

[Reference Example 2] Humanization of the H Chain of the Anti-CD3 Antibody, rCE115, and Sharing of a Common L Chain (2-1) Design of hCE115HA, the Humanized rCE115 H-Chain Variable Region The H-chain variable region of the rCE115 anti-CD3 antibody (SEQ ID NO: 42) was humanized. CDR and FR were determined as defined by Kabat (Kabat numbering).

First, a human FR sequence was selected by comparing the human antibody variable region sequences in a database to the rCE115 rat variable region sequence. The IMGT Database (http://www.imgt.org/) and NCBI GenBank (http://www.ncbi.nlm.nih.gov/genbank/) were used for the database. A humanized H-chain variable region sequence was designed by linking the H-chain CDR sequence of the rCE115 variable region with the selected human FR sequence. This yielded a humanized H-chain variable region sequence, hCE115HL (SEQ ID NO: 51).

The amino acid residue at position 93 indicated by Kabat numbering is Ala in the selected human H-chain FR3 sequence, but is Arg in the rCE115 variable region sequence.

Using the database of rat and human germline sequences (IMGT Database (http://www.imgt.org/)), only few sequences were found to contain Arg at this site. It is reported that the amino acid residue at position 94 indicated by Kabat numbering contributes to stabilization of the antibody structure by upper core formation (Ewert et al. Methods. 2004 October; 34(2):184-99). Based on such information, a humanized H-chain variable region sequence, in which the amino acid residues at Kabat positions 93 and 94 in the H-chain FR3 were substituted with those residues present in the rCE115 variable region sequence, was newly designed. This was the humanized H-chain variable region sequence, hCE115HA (SEQ ID NO: 52).

(2-2) Design of the Common L Chain, L0000, for the rCE115 Anti-CD3 Antibody and the Anti-GPC3 Antibody The FR/CDR shuffling of the L-chain variable region rCE115L (SEQ ID NO: 43) of the rCE115 anti-CD3 antibody and the L-chain variable region GL4 (SEQ ID NO: 41) of the anti-GPC3 antibody was performed.

The FR sequence of GL4 was selected as the L-chain FR sequence. L-chain CDR2 was the same for rCE115L and GL4. The L-chain CDR1 was selected from the CDR sequences of GL4, and the L-chain CDR3 was selected from the CDR sequences of rCE115L, respectively. Furthermore, the L-chain CDR3 produced by substituting the amino acid residue Asp at Kabat position 94 of the selected L-chain CDR3 with the Val residue present in GL4 was newly designed.

A humanized L chain variable region sequence was designed by linking FR and CDR selected above. This yielded a humanized L-chain variable region sequence, L0000 (SEQ ID NO: 53).

(2-3) Evaluation of the Affinity for Human GPC3

The activity to bind human GPC3 when using GL4 (SEQ ID NO: 41) and L0000 (SEQ ID NO: 53) as the L-chain variable regions was evaluated. This was performed using the molecular form of a single-arm antibody having a single Fab at the Fc region of a human IgG heterodimerized by the knobs-into-hole technique. H0000 (SEQ ID NO: 40) was used for the anti-GPC3 antibody H-chain variable region.

The affinity and binding rate constants of an anti-GPC3 antibody for an antigen were measured by the multi-cycle kinetics method of a surface plasmon resonance assay using Biacore™-T200 (GE Healthcare Japan). HBS-EP+ (GE Healthcare Japan) was used for the running buffer, and an amine coupling kit (GE Healthcare Japan) was used to covalently bind Protein A/G to the CM5 chip (carboxymethyl dextran-coated chip). Each anti-GPC3 antibody was prepared so that approximately 100 RU will be captured by Protein A/G. Human GPC3 used as the analyte was prepared at 8, 16, 32, 64, and 128 nM using HBS-EP+. Measurements were carried out by first allowing Protein A/G to capture the antibody solution, and then injecting the human GPC3 solution at a flow rate of 30 μL/min for three minutes to allow reaction to take place. Then, the solution was switched to HBS-EP+ and the dissociation phase was measured for 15 minutes. After completion of the dissociation phase measurement, the sensor chip was regenerated by washing with 10 mM Gly-HCl at pH 1.5. Measurement at the concentration of 0 was similarly carried out by allowing Protein A/G to capture the antibody solution, performing a three-minute HBS-EP+ injection to allow reaction to take place, and then switching to HBS-EP+ to measure the dissociation phase for 15 minutes. After completion of the dissociation phase measurement, the sensor chip was regenerated by washing with 10 mM Gly-HCl at pH 1.5. A data analysis software exclusively for Biacore, Biacore T200 Evaluation Software Version 1.0, was used to perform kinetic analyses to calculate the binding rate constant (ka), dissociation rate constant (kd), and the rate constant ratio from the obtained sensorgrams. The results are shown in Table 10.

TABLE 10

| Variable region | | Affinity for human GPC3 | | |
|---|---|---|---|---|
| H-chain variable region | L-chain variable region | KD (M) | ka (1/Ms) | kd (1/s) |
| H0000 | GL4 | $4.2 \times 10^{-9}$ | $4.3 \times 10^{5}$ | $1.8 \times 10^{-3}$ |
| H0000 | L0000 | $3.6 \times 10^{-8}$ | $3.0 \times 10^{5}$ | $1.1 \times 10^{-2}$ |

(2-4) Evaluation of the Affinity for Human CD3

The activity to bind human CD3 when using hCE115HA (SEQ ID NO: 52) as the H chain variable region and L0000 (SEQ ID NO: 53) as the L-chain variable region was evaluated. This was performed using the molecular form of a single-arm antibody having a single Fab at the Fc region of a human IgG1 heterodimerized by the knobs-into-hole technique.

The affinity and binding rate constants of an anti-CD3 antibody for an antigen were measured by the single-cycle kinetics method of a surface plasmon resonance assay using Biacore™-T200 (GE Healthcare Japan). HBS-EP+ (GE Healthcare Japan) was used for the running buffer, and an amine coupling kit (GE Healthcare Japan) was used to covalently bind human CD3 to the CM4 chip (carboxymethyl dextran-coated chip). The anti-CD3 antibody used as the analyte was prepared at 5 and 20 μg/mL using HBS-EP+. Measurements were carried out by first injecting each of the 5- and 20-μg/mL anti-CD3 antibody solutions for three minutes continuously at a flow rate of 20 μL/min to allow reaction to take place. Then, the solution was switched to HBS-EP+ and the dissociation phase was measured for 3 minutes. After completion of the dissociation phase measurement, the sensor chip was regenerated by washing with 10 mM Gly-HCl at pH 1.5. Measurement at the concentration of 0 was carried out by performing each of the three-minute HBS-EP+ injections twice successively to allow reaction to take place, and then switching to HBS-EP+ to measure the dissociation phase for 3 minutes. After completion of the dissociation phase measurement, the sensor chip was regenerated by washing with 10 mM Gly-HCl at pH 1.5. A data analysis software exclusively for Biacore, Biacore T200 Evaluation Software Version 1.0, was used to perform kinetic analyses to calculate the binding rate constant (ka), dissociation rate constant (kd), and the rate constant ratio from the obtained sensorgrams. The results are shown in Table 11.

TABLE 11

| Variable region | | Affinity for human CD3 | | |
|---|---|---|---|---|
| H-chain variable region | L-chain variable region | KD (M) | ka (1/Ms) | kd (1/s) |
| rCE115H | rCE115L | $1.0 \times 10^{-7}$ | $5.9 \times 10^{4}$ | $6.0 \times 10^{-3}$ |
| hCE115HA | L0000 | $1.2 \times 10^{-7}$ | $1.9 \times 10^{5}$ | $2.3 \times 10^{-2}$ |

(2-5) Preparation of GPC3_ERY27_hCE115

The IgG4 against a cancer antigen (GPC3) was used as the basic structure to produce the ERY27 molecule (FIG. 12b), in which the H-chain variable region of one of the Fabs has been replaced with a CD3 epsilon-binding domain, and the L chain is common to both Fabs. In this case, the IgG4 Fc used as the basic structure was a silent Fc with attenuated affinity for FcgR (an Fcγ receptor). H0000 (SEQ ID NO: 40) was used as the H-chain variable region of the GPC3-binding domain, and hCE115HA (SEQ ID NO: 52) was used as the H-chain variable region of the CD3-binding domain. L0000 (SEQ ID NO: 53) was used as the L-chain variable region. The D356K and K439E mutations introduced into the respective H chains were introduced for efficient heteromer formation of each H chain when producing heterodimeric antibodies comprising two types of H chains (WO2006/106905). H435R is a modification that interrupts binding to Protein A, and was introduced for efficient separation of the heteromer and homomer (WO/2011/078332).

A series of expression vectors inserted with a polynucleotide encoding each of H0000-ERY27_HK (SEQ ID NO: 54), hCE15HA-ERY27_HE (SEQ ID NO: 55), and L0000-k0 (SEQ ID NO: 56) were produced by well-known methods.

The following combination of expression vectors were introduced into FreeStyle 293-F cells for transient expression of each target molecule.

Target molecule: GPC3_ERY27_hCE115
Polypeptides encoded by the polynucleotides inserted into the expression vectors: H0000-ERY27_HK, hCE15HA-ERY27_HE, and L0000-k0

(2-6) Purification of GPC3_ERY27_hCE115

Each molecule of interest was purified by the method described in Reference Example 1-2.

(2-7) Measurement of Cytotoxic Activity Using Human Peripheral Blood Mononuclear Cells (2-7-1) Preparation of a Human Peripheral Blood Mononuclear Cell (PBMC) Solution The solution was prepared by the method described in Reference Example 1-3-1.

(2-7-2) Measurement of Cytotoxic Activity

Cytotoxic activity was measured by the method described in Reference Example 1-3-2.

When PBMCs prepared from human blood were used as the effector cell to measure the cytotoxicity of GPC3_ERY27_hCE115, reduction of the activity was observed as a result of humanization of the H chain of rCE115 and sharing of a common L chain (FIG. 13).

[Reference Example 3] Production and Evaluation of Humanized Bispecific Antibody Variants for Improvement of Various Properties The T-cell-dependent cytotoxic activity of the humanized anti-human CD3ε (CD3 epsilon) chain and anti-human GPC3 bispecific antibody obtained in Reference Example 2, GPC3_ERY27_hCE115 (SEQ ID NOs: 54, 55, and 56), was lower than the T-cell-dependent cytotoxic activity of GPC3_ERY22_rCE115 (SEQ ID NOs: 47, 48, 49, and 50). This may be due to attenuation of affinity for GPC3 and the CD3ε chain as a result of humanization and sharing of a common L chain. Regarding GPC3 and CD3ε-chain antigens which have independent sequences, there has been no report so far on humanized bispecific antibodies whose T-cell dependent cytotoxic activity has been enhanced and whose affinity for both antigens has been improved by using a common antibody L chain. Therefore, it has been considered difficult to obtain humanized antibodies with dual specificity that show a drug efficacy equivalent to or greater than that of GPC3_ERY22_rCE115.

Under such circumstances, the Applicants produced modified humanized bispecific antibodies with modified affinity for human GPC3 and human CD3ε chain by methods known to those skilled in the art, which involves comprehensively substituting amino acid residues encoded by the antibody gene to produce antibody variants against both the human GPC3 and human CD3ε-chain antigens, and by performing various evaluations by screening. Furthermore, similar methods were used to produce modified humanized bispecific antibodies with modified physicochemical properties. Furthermore, by combining substitutions of amino acid residues effective for modifying affinity and physicochemical properties, optimized bispecific antibodies having a TDCC activity equivalent to or greater than the T-cell dependent cellular cytotoxicity of GPC3_ERY22_rCE115 prior to humanization were produced.

Introduction of point mutations, expression and purification of antibodies, antigen affinity measurements, and determination of T-cell dependent cellular cytotoxicity in the optimization of humanized bispecific antibodies were performed by methods similar to those in Reference Examples 1 and 2. CDR and FR were determined according to the Kabat definition (Kabat numbering).

Depending on the objective, the following were used as the antibody H-chain constant regions (the numbers indicate EU numbering): E22Hh (SEQ ID NO: 57) produced by introducing L234A/L235A/N297A/D356C/T366S/L368A/Y407V/G446 deletion/K447 deletion mutations into human IgG1; E22Hk (SEQ ID NO: 58) produced by introducing L234A/L235A/N297A/Y349C/T366W/G446 deletion/K447 deletion mutations and a Ser-Ser insertion mutation immediately before position 118 into human IgG1; G1dh produced by introducing D356C/T366S/L368A/Y407V/G446 deletion/K447 deletion mutations into human IgG1; none-Hi-Kn010G3 produced by introducing 118-215 deletion and C220S/Y349C/T366W/H435R mutations into human IgG1; E2702GsKsc (SEQ ID NO: 60) produced by introducing L235R/S239K/N297A/E356K/R409K/H435R/L445P/G446 deletion/K447 deletion mutations into human IgG4; E2704sEpsc (SEQ ID NO: 61) produced by introducing K196Q/L235R/S239K/N297A/R409K/K439E/L445P/G446 deletion/K447 deletion mutations into human IgG4; and E2702sKsc (SEQ ID NO: 62) produced by introducing L235R/S239K/N297A/E356K/R409K/L445P/G446 deletion/K447 deletion mutations into human IgG4. Furthermore, human κ (kappa) chain k0 (SEQ ID NO: 63) and E22L (SEQ ID NO: 432) produced by introducing R108A/T109S mutations into human κ chain were used as the antibody L-chain constant regions.

The mutation that substitutes Cys for Asp at EU numbering position 356, the mutation that substitutes Ser for The at EU numbering position 366, the mutation that substitutes Ala for Leu at EU numbering position 368, the mutation that substitutes Val for Tyr at EU numbering position 407, the mutation that substitutes Cys for Tyr at EU numbering position 349, the mutation that substitutes Trp for Thr at EU numbering position 366, and the mutation that inserts Ser-Ser immediately before position 118 are mutations for efficient formation of heterodimeric molecules for each H chain when producing heteromeric antibodies. Similarly, the mutation that substitutes Lys for Glu at EU numbering position 356 and the mutation that substitutes Glu for Lys at EU numbering position 439 are also mutations for efficient formation of heterodimeric molecules for each H chain when producing heteromeric antibodies. They are expected to improve the efficiency of bispecific antibody production.

The mutation that substitutes Ala for Leu at EU numbering position 234, the mutation that substitutes Ala or Arg for Leu at EU numbering position 235, the mutation that substitutes Lys for Ser at EU numbering position 239, and the mutation that substitutes Ala for Asn at EU numbering position 297 are mutations for attenuating affinity for an Fcγ receptor and a complement (C1q). They are expected to suppress the binding of Fab to CD3 and Fc-mediated cross-linking of an Fcγ receptor or a complement, and avoid cytokine release syndrome that accompanies enhancement of non-specific effector functions.

The H chain introduced with deletion mutations at EU numbering positions 118 to 215 can be combined with a full-length H chain sequence to produce an antibody that has only one Fab (monovalent antibody), and it is useful for affinity evaluation.

The mutation that substitutes Lys for Arg at EU numbering position 409 and the mutation that substitutes Arg for His at EU numbering position 435 are mutations for modifying the antibody properties to be close to the properties of human IgG and human IgG3, respectively.

(3-1) Modifying the Affinity of a Humanized Anti-CD3 Antibody by Point Mutations First, point mutations were introduced into FR1, FR2, FR3, CDR1, CDR2, and CDR3 of the humanized anti-human CD3ε chain antibody sequence produced in Reference Example 2, hCE115HA-ERY27_HE (SEQ ID NO: 55), to prepare modified antibodies. Next, the affinity of these modified antibodies for the soluble human CD3ε chain was determined. Combining sites that have an affinity-enhancing effect yielded modified antibodies having the affinities shown in Table 12.

TABLE 12

| Antibody name | KD (Human CD3) |
|---|---|
| hCE115HA-E22Hh//-Hi-Kn010G3/L0000-k0 | 1.43E−07 |
| TR01H083-E22Hh/none-Hi-Kn010G3/L0212-k0 | 5.86E−11 |
| TR01H040-E22Hh/none-Hi-Kn010G3/L0240-k0 | 2.17E−09 |
| TR01H002-E22Hh/GLS3108-k0/GL4-E22Hk/H0610-E22L | 2.04E−09 |
| TR01H040-E22Hh/none-Hi-Kn010G3/L0212-k0 | 2.17E−09 |
| TR01H040-E22Hh/none-Hi-Kn010G3/L0235-k0 | 2.81E−09 |
| TR01H040-E22Hh/none-Hi-Kn010G3/L0238-k0 | 2.91E−09 |
| TR01H040-E22Hh/none-Hi-Kn010G3/TR01L016-k0 | 2.52E−09 |
| TR01H083-E22Hh/none-Hi-Kn010G3/L0262-k0 | 2.45E−09 |
| TR01H040-E22Hh/none-Hi-Kn010G3/L0207-k0 | 2.60E−09 |
| TR01H040-E22Hh/none-Hi-Kn010G3/L0241-k0 | 3.48E−09 |
| TR01H040-E22Hh/none-Hi-Kn010G3/L0242-k0 | 3.58E−09 |
| TR01H040-E22Hh/none-Hi-Kn010G3/L0206-k0 | 2.90E−09 |
| TR01H040-E22Hh/none-Hi-Kn010G3/TR01L019-k0 | 3.20E−09 |
| TR01H080-E22Hh/none-Hi-Kn010G3/L0000-k0 | 3.25E−09 |
| TR01H040-E22Hh/none-Hi-Kn010G3/L0211-k0 | 3.22E−09 |
| TR01H002-E22Hh//-Hi-Kn010G3/GLC3108-k0 | 4.61E−09 |
| TR01H040-E22Hh/none-Hi-Kn010G3/L0209-k0 | 4.25E−09 |
| TR01H040-E22Hh/none-Hi-Kn010G3/L0208-k0 | 4.16E−09 |
| TR01H040-E22Hh/none-Hi-Kn010G3/L0224-k0 | 5.06E−09 |
| TR01H040-E22Hh/none-Hi-Kn010G3/L0236-k0 | 5.64E−09 |
| TR01H083-E22Hh/none-Hi-Kn010G3/L0201-k0 | 4.42E−09 |
| TR01H084-E2702GsKsc/none-Hi-E2704sE/L0011-k0 | 4.14E−09 |
| TR01H040-E22Hh/none-Hi-Kn010G3/L0210-k0 | 5.06E−09 |
| TR01H114-E2702GsKsc/none-Hi-E2704sE/L0011-k0 | 4.22E−09 |
| CE115HA236-E22Hh/GLS3108-k0/GL4-E22Hk/H0610-E22L | 6.08E−09 |
| TR01H077-E22Hh/none-Hi-Kn010G3/L0200-k0 | 6.12E−09 |
| TR01H071-E22Hh/none-Hi-Kn010G3/L0200-k0 | 6.13E−09 |
| TR01H111-E2702GsKsc/none-Hi-E2704sE/L0011-k0 | 4.91E−09 |
| TR01H081-E22Hh/none-Hi-Kn010G3/L0262-k0 | 5.76E−09 |
| TR01H001-E22Hh//-Hi-Kn010G3/GLC3108-k0 | 8.22E−09 |
| CE115HA179-G1dh//-Hi-Kn010G3/L0000-k0 | 8.35E−09 |
| TR01H112-E2702GsKsc/none-Hi-E2704sE/L0011-k0 | 5.12E−09 |
| TR01H113-E2702GsKsc/none-Hi-E2704sE/L0011-k0 | 5.14E−09 |
| TR01H082-E22Hh/none-Hi-Kn010G3/L0212-k0 | 4.75E−09 |
| CE115HA236-E22Hh//-Hi-Kn010G3/GLC3108-k0 | 9.10E−09 |
| TR01H040-E22Hh/none-Hi-Kn010G3/L0231-k0 | 7.75E−09 |
| TR01H037-E22Hh/none-Hi-Kn010G3/L0000-k0 | 6.93E−09 |
| CE115HA252-E22Hh//-Hi-Kn010G3/L0000-k0 | 9.48E−09 |
| TR01H083-E22Hh/none-Hi-Kn010G3/L0011-k0 | 6.70E−09 |
| TR01H040-E22Hh/none-Hi-Kn010G3/L0223-k0 | 8.15E−09 |
| TR01H083-E22Hh/none-Hi-Kn010G3/L0000-k0 | 6.83E−09 |
| TR01H071-E22Hh/none-Hi-Kn010G3/L0000-k0 | 8.85E−09 |
| TR01H067-E22Hh/none-Hi-Kn010G3/L0212-k0 | 5.88E−09 |
| CE115HA178-G1dh//-Hi-Kn010G3/L0000-k0 | 1.09E−08 |
| TR01H040-E22Hh/none-Hi-Kn010G3/L0237-k0 | 1.02E−08 |
| TR01H083-E22Hh/none-Hi-Kn010G3/L0222-k0 | 9.42E−09 |
| TR01H084-E22Hh/none-Hi-Kn010G3/L0262-k0 | 8.51E−09 |
| TR01H071-E22Hh/none-Hi-Kn010G3/L0215-k0 | 9.51E−09 |
| TR01H040-E22Hh/none-Hi-Kn010G3/L0218-k0 | 8.20E−09 |
| TR01H081-E22Hh/none-Hi-Kn010G3/L0201-k0 | 9.46E−09 |
| TR01H071-E22Hh/none-Hi-Kn010G3/L0222-k0 | 1.04E−08 |
| TR01H040-E22Hh/none-Hi-Kn010G3/L0220-k0 | 9.15E−09 |
| TR01H067-E22Hh/none-Hi-Kn010G3/TR01L016-k0 | 1.09E−08 |
| TR01H002-E22Hh/GLS3108-k0/GL4-E22Hk/H0000-E22L | 4.76E−09 |
| TR01H067-E22Hh/none-Hi-Kn010G3/TR01L019-k0 | 1.21E−08 |
| TR01H038-E22Hh/none-Hi-Kn010G3/L0000-k0 | 1.24E−08 |
| TR01H061-E22Hh/none-Hi-Kn010G3/L0200-k0 | 1.27E−08 |
| TR01H082-E2702GsKsc/none-Hi-E2704sE/L0011-k0 | 1.01E−08 |
| CE115HA180-G1dh//-Hi-Kn010G3/L0000-k0 | 1.68E−08 |
| CE115HA251-E22Hh/L0000-k0/GL4-E22Hk/H0610-E22L | 1.37E−08 |
| TR01H100-E2702GsKsc/none-Hi-E2704sE/L0011-k0 | 1.11E−08 |
| TR01H040-E22Hh/none-Hi-Kn010G3/L0228-k0 | 1.60E−08 |
| TR01H081-E22Hh/none-Hi-Kn010G3/L0011-k0 | 1.35E−08 |
| TR01H061-E22Hh/none-Hi-Kn010G3/L0215-k0 | 1.54E−08 |
| TR01H110-E2702GsKsc/none-Hi-E2704sE/L0011-k0 | 1.26E−08 |
| TR01H043-E22Hh/none-Hi-Kn010G3/L0000-k0 | 1.52E−08 |
| TR01H081-E22Hh/none-Hi-Kn010G3/L0000-k0 | 1.56E−08 |
| CE115HA251-E22Hh//-Hi-Kn010G3/L0000-k0 | 2.23E−08 |
| TR01H091-E2702GsKsc/none-Hi-E2704sE/L0011-k0 | 1.39E−08 |
| CE115HA236-E22Hh/GLS3108-k0/GL4-E22Hk/H0000-E22L | 6.95E−09 |
| TR01H084-E22Hh/none-Hi-Kn010G3/L0201-k0 | 1.65E−08 |
| TR01H072-E22Hh/none-Hi-Kn010G3/L0000-k0 | 2.03E−08 |
| TR01H099-E2702GsKsc/none-Hi-E2704sE/L0011-k0 | 1.46E−08 |
| TR01H061-E22Hh/none-Hi-Kn010G3/L0222-k0 | 1.88E−08 |
| TR01H040-E22Hh/none-Hi-Kn010G3/L0239-k0 | 2.31E−08 |
| TR01H040-E22Hh/none-Hi-Kn010G3/L0262-k0 | 1.81E−08 |
| TR01H040-E22Hh/none-Hi-Kn010G3/L0234-k0 | 2.40E−08 |
| TR01H012-E22Hh/none-Hi-Kn010G3/L0000-k0 | 7.94E−09 |
| TR01H061-E22Hh/none-Hi-Kn010G3/L0000-k0 | 1.71E−08 |
| TR01H040-E22Hh/none-Hi-Kn010G3/L0243-k0 | 2.46E−08 |
| TR01H109-E2702GsKsc/none-Hi-E2704sE/L0011-k0 | 1.64E−08 |
| TR01H047-E22Hh/none-Hi-Kn010G3/L0000-k0 | 2.04E−08 |
| TR01H082-E22Hh/none-Hi-Kn010G3/L0267-k0 | 2.29E−08 |
| TR01H082-E22Hh/none-Hi-Kn010G3/L0266-k0 | 2.29E−08 |
| TR01H084-E22Hh/none-Hi-Kn010G3/L0011-k0 | 1.98E−08 |
| TR01H040-E22Hh/none-Hi-Kn010G3/L0250-k0 | 2.15E−08 |
| TR01H040-E22Hh/none-Hi-Kn010G3/L0204-k0 | 2.21E−08 |
| TR01H084-E22Hh/none-Hi-Kn010G3/L0000-k0 | 2.13E−08 |
| TR01H040-E22Hh/none-Hi-Kn010G3/L0213-k0 | 2.01E−08 |
| hCE115HA-E22Hh//-Hi-Kn010G3/L0000-k0 | 1.43E−07 |
| TR01H040-E22Hh/none-Hi-Kn010G3/L0214-k0 | 2.02E−08 |
| TR01H040-E22Hh/none-Hi-Kn010G3/L0217-k0 | 2.07E−08 |
| TR01H071-E22Hh/none-Hi-Kn010G3/L0226-k0 | 2.51E−08 |
| TR01H040-E22Hh/none-Hi-Kn010G3/L0200-k0 | 2.87E−08 |
| TR01H074-E22Hh/none-Hi-Kn010G3/L0000-k0 | 2.91E−08 |
| TR01H039-E22Hh/none-Hi-Kn010G3/L0000-k0 | 2.61E−08 |
| CE115HA177-G1dh//-Hi-Kn010G3/L0000-k0 | 3.55E−08 |
| TR01H040-E22Hh/none-Hi-Kn010G3/L0201-k0 | 2.81E−08 |
| TR01H082-E22Hh/none-Hi-Kn010G3/L0263-k0 | 3.09E−08 |
| TR01H040-E22Hh/none-Hi-Kn010G3/L0000-k0 | 3.60E−08 |
| TR01H040-E22Hh/none-Hi-Kn010G3/L0216-k0 | 2.53E−08 |
| TR01H051-E22Hh/none-Hi-Kn010G3/L0000-k0 | 2.91E−08 |
| TR01H003-E22Hh//-Hi-Kn010G3/L0000-k0 | 4.03E−08 |
| TR01H082-E22Hh/none-Hi-Kn010G3/L0264-k0 | 3.44E−08 |
| TR01H040-E22Hh/none-Hi-Kn010G3/L0232-k0 | 3.86E−08 |
| TR01H041-E22Hh/none-Hi-Kn010G3/L0000-k0 | 3.16E−08 |
| CE115HA122-E22Hh//-Hi-Kn010G3/L0000-k0 | 4.28E−08 |
| TR01H040-E22Hh/none-Hi-Kn010G3/L0233-k0 | 4.01E−08 |
| TR01H040-E22Hh/none-Hi-Kn010G3/L0215-k0 | 3.37E−08 |
| TR01H040-E22Hh/none-Hi-Kn010G3/L0203-k0 | 3.24E−08 |

TABLE 12-continued

| Antibody name | KD (Human CD3) |
|---|---|
| TR01H015-E2702GsKsc/GCH019-E2704sEpsc/L0000-k0 | 2.96E-08 |
| TR01H040-E22Hh/none-Hi-Kn010G3/TR01L008-k0 | 2.93E-08 |
| TR01H040-E22Hh/none-Hi-Kn010G3/L0205-k0 | 3.42E-08 |
| TR01H015-E22Hh/L0000-k0/GL4-E22Hk/H0610-E22L | 3.57E-08 |
| TR01H064-E22Hh/none-Hi-Kn010G3/L0000-k0 | 3.07E-08 |
| TR01H044-E22Hh/none-Hi-Kn010G3/L0000-k0 | 3.52E-08 |
| TR01H082-E22Hh/none-Hi-Kn010G3/L0262-k0 | 3.98E-08 |
| TR01H062-E22Hh/none-Hi-Kn010G3/L0000-k0 | 3.13E-08 |
| CE115HA251-E22Hh/L0000-k0/GL4-E22Hk/H0000-E22L | 1.48E-08 |
| TR01H040-E22Hh/none-Hi-Kn010G3/L0011-k0 | 3.48E-08 |
| TR01H040-E22Hh/none-Hi-Kn010G3/L0222-k0 | 4.65E-08 |
| CE115HA192-E22Hh//-Hi-Kn010G3/L0000-k0 | 5.05E-08 |
| TR01H040-E22Hh/none-Hi-Kn010G3/TR01L010-k0 | 3.28E-08 |
| TR01H025-E22Hh/none-Hi-Kn010G3/L0000-k0 | 3.86E-08 |
| TR01H082-E22Hh/none-Hi-Kn010G3/TR01L023-k0 | 4.25E-08 |
| TR01H040-E22Hh/none-Hi-Kn010G3/TR01L015-k0 | 3.95E-08 |
| TR01H055-E22Hh/none-Hi-Kn010G3/L0000-k0 | 3.88E-08 |
| TR01H082-E22Hh/none-Hi-Kn010G3/L0260-k0 | 4.53E-08 |
| TR01H040-E22Hh/none-Hi-Kn010G3/TR01L009-k0 | 3.56E-08 |
| TR01H040-E22Hh/none-Hi-Kn010G3/TR01L011-k0 | 3.57E-08 |
| TR01H017-E22Hh/none-Hi-Kn010G3/L0000-k0 | 3.50E-08 |
| CE115HA122-E22Hh/L0000-k0/GL4-E22Hk/H0000-E22L | 1.69E-08 |
| TR01H076-E22Hh/none-Hi-Kn010G3/L0000-k0 | 4.78E-08 |
| TR01H082-E22Hh/none-Hi-Kn010G3/L0258-k0 | 4.70E-08 |
| TR01H046-E22Hh/none-Hi-Kn010G3/L0000-k0 | 4.23E-08 |
| rCE115H-G1dh//-Hi-Kn010G3/L0000-k0 | 5.76E-08 |
| TR01H082-E22Hh/none-Hi-Kn010G3/TR01L024-k0 | 4.76E-08 |
| TR01H016-E22Hh/none-Hi-Kn010G3/L0000-k0 | 3.69E-08 |
| TR01H040-E22Hh/none-Hi-Kn010G3/TR01L018-k0 | 4.51E-08 |
| TR01H084-E22Hh/none-Hi-Kn010G3/L0271-k0 | 2.76E-08 |
| TR01H084-E22Hh/none-Hi-Kn010G3/L0270-k0 | 2.76E-08 |
| TR01H040-E22Hh/none-Hi-Kn010G3/L0000vk1-k0 | 4.69E-08 |
| TR01H040-E22Hh/none-Hi-Kn010G3/L0219-k0 | 3.94E-08 |
| TR01H014-E22Hh/none-Hi-Kn010G3/L0000-k0 | 3.87E-08 |
| TR01H061-E22Hh/none-Hi-Kn010G3/L0226-k0 | 4.71E-08 |
| TR01H048-E22Hh/none-Hi-Kn010G3/L0000-k0 | 4.52E-08 |
| TR01H082-E22Hh/none-Hi-Kn010G3/L0259-k0 | 5.07E-08 |
| TR01H028-E22Hh/none-Hi-Kn010G3/L0000-k0 | 4.80E-08 |
| TR01H082-E22Hh/none-Hi-Kn010G3/L0201-k0 | 4.49E-08 |
| TR01H040-E22Hh/none-Hi-Kn010G3/TR01L013-k0 | 4.15E-08 |
| TR01H033-E22Hh/none-Hi-Kn010G3/L0000-k0 | 4.88E-08 |
| hCE115HA-G1dh//-Hi-Kn010G3/L0000-k0 | 6.50E-08 |
| TR01H040-E22Hh/none-Hi-Kn010G3/TR01L012-k0 | 4.22E-08 |
| TR01H065-E22Hh/none-Hi-Kn010G3/L0000-k0 | 4.31E-08 |
| TR01H079-E22Hh/none-Hi-Kn010G3/L0000-k0 | 5.05E-08 |
| TR01H042-E22Hh/none-Hi-Kn010G3/L0000-k0 | 4.48E-08 |
| TR01H063-E22Hh/none-Hi-Kn010G3/L0000-k0 | 4.35E-08 |
| TR01H084-E22Hh/none-Hi-Kn010G3/L0272-k0 | 3.10E-08 |
| CE115HA121-E22Hh//-Hi-Kn010G3/L0000-k0 | 6.76E-08 |
| TR01H026-E22Hh/none-Hi-Kn010G3/L0000-k0 | 5.12E-08 |
| TR01H067-E22Hh/none-Hi-Kn010G3/L0262-k0 | 4.92E-08 |
| TR01H073-E22Hh/none-Hi-Kn010G3/L0000-k0 | 5.97E-08 |
| TR01H045-E22Hh/none-Hi-Kn010G3/L0000-k0 | 5.22E-08 |
| TR01H007-E22Hh/none-Hi-Kn010G3/L0000-k0 | 2.17E-08 |
| TR01H082-E22Hh/none-Hi-Kn010G3/L0203-k0 | 4.07E-08 |
| TR01H032-E22Hh/none-Hi-Kn010G3/L0000-k0 | 5.73E-08 |
| TR01H006-E22Hh/none-Hi-Kn010G3/L0000-k0 | 2.30E-08 |
| TR01H013-E22Hh/none-Hi-Kn010G3/L0000-k0 | 4.94E-08 |
| TR01H050-E22Hh/none-Hi-Kn010G3/L0000-k0 | 5.76E-08 |
| TR01H067-E22Hh/none-Hi-Kn010G3/L0200-k0 | 6.03E-08 |
| TR01H015-E22Hh/none-Hi-Kn010G3/L0000-k0 | 6.13E-08 |
| hCE115HA-E22Hh/L0000-k0/GL4-E22Hk/H0000-E22L | 6.16E-08 |
| hCE115HA-E22stHh/none-Hi-stKn010G3/L0000-k0 | 5.17E-08 |
| TR01H069-E22Hh/none-Hi-Kn010G3/L0000-k0 | 7.11E-08 |
| TR01H015-E22Hh/none-Hi-Kn010G3/TR01L003-k0 | 6.34E-08 |
| TR01H040-E22Hh/none-Hi-Kn010G3/L0202-k0 | 6.19E-08 |
| TR01H067-E22Hh/none-Hi-Kn010G3/L0201-k0 | 5.93E-08 |
| TR01H020-E22Hh/none-Hi-Kn010G3/L0000-k0 | 6.48E-08 |
| TR01H082-E22Hh/none-Hi-Kn010G3/L0011-k0 | 5.95E-08 |
| hCE115HA-E22Hh//-Hi-Kn010G3/L0000-k0 | 1.43E-07 |
| TR01H082-E22Hh/none-Hi-Kn010G3/TR01L018-k0 | 4.72E-08 |
| TR01H015-E22Hh/none-Hi-Kn010G3/TR01L005-k0 | 6.53E-08 |
| TR01H052-E22Hh/none-Hi-Kn010G3/L0000-k0 | 6.27E-08 |
| TR01H036-E22Hh/none-Hi-Kn010G3/L0000-k0 | 6.50E-08 |
| TR01H067-E22Hh/none-Hi-Kn010G3/L0203-k0 | 4.79E-08 |
| TR01H030-E22Hh/none-Hi-Kn010G3/L0000-k0 | 6.54E-08 |
| TR01H015-E22Hh/none-Hi-Kn010G3/TR01L001-k0 | 6.56E-08 |
| TR01H100-E22Hh/none-Hi-Kn010G3/L0011-k0 | 6.25E-08 |
| TR01H029-E22Hh/none-Hi-Kn010G3/L0000-k0 | 6.70E-08 |
| TR01H019-E22Hh/none-Hi-Kn010G3/L0000-k0 | 6.85E-08 |
| TR01H082-E22Hh/none-Hi-Kn010G3/L0000-k0 | 7.37E-08 |
| TR01H018-E22Hh/none-Hi-Kn010G3/L0000-k0 | 6.93E-08 |
| TR01H027-E22Hh/none-Hi-Kn010G3/L0000-k0 | 6.95E-08 |
| TR01H049-E22Hh/none-Hi-Kn010G3/L0000-k0 | 6.79E-08 |
| TR01H066-E22Hh/none-Hi-Kn010G3/L0000-k0 | 6.02E-08 |
| TR01H091-E22Hh/none-Hi-Kn010G3/L0011-k0 | 6.67E-08 |
| rCE115H-E22Hh/none-Hi-Kn010G3/L0000-k0 | 8.00E-08 |
| TR01H015-E22Hh/none-Hi-Kn010G3/TR01L002-k0 | 7.14E-08 |
| TR01H040-E22Hh/none-Hi-Kn010G3/L0226-k0 | 8.01E-08 |
| TR01H067-E22Hh/none-Hi-Kn010G3/TR01L018-k0 | 5.26E-08 |
| TR01H093-E22Hh/none-Hi-Kn010G3/L0011-k0 | 6.80E-08 |
| TR01H067-E22Hh/none-Hi-Kn010G3/L0215-k0 | 7.41E-08 |
| TR01H015-E22Hh/none-Hi-Kn010G3/TR01L004-k0 | 7.34E-08 |
| TR01H107-E22Hh/none-Hi-Kn010G3/L0011-k0 | 6.91E-08 |
| TR01H105-E22Hh/none-Hi-Kn010G3/L0011-k0 | 6.95E-08 |
| TR01H090-E22Hh/none-Hi-Kn010G3/L0011-k0 | 6.95E-08 |
| TR01H108-E22Hh/none-Hi-Kn010G3/L0011-k0 | 6.98E-08 |
| TR01H094-E22Hh/none-Hi-Kn010G3/L0011-k0 | 7.00E-08 |
| TR01H109-E22Hh/none-Hi-Kn010G3/L0011-k0 | 7.06E-08 |
| TR01H056-E22Hh/none-Hi-Kn010G3/L0000-k0 | 7.32E-08 |
| TR01H031-E22Hh/none-Hi-Kn010G3/L0000-k0 | 7.55E-08 |
| TR01H022-E22Hh/none-Hi-Kn010G3/L0000-k0 | 7.58E-08 |
| TR01H092-E22Hh/none-Hi-Kn010G3/L0011-k0 | 7.21E-08 |
| TR01H067-E22Hh/none-Hi-Kn010G3/L0000-k0 | 7.15E-08 |
| TR01H067-E22Hh/none-Hi-Kn010G3/L0011-k0 | 7.18E-08 |
| TR01H040-E22Hh/none-Hi-Kn010G3/L0248-k0 | 7.89E-08 |
| TR01H009-E22Hh/none-Hi-Kn010G3/L0000-k0 | 3.15E-08 |
| TR01H023-E22Hh/none-Hi-Kn010G3/L0000-k0 | 7.94E-08 |
| TR01H096-E22Hh/none-Hi-Kn010G3/L0011-k0 | 7.47E-08 |
| TR01H040-E22Hh/none-Hi-Kn010G3/TR01L007-k0 | 6.82E-08 |
| TR01H054-E22Hh/none-Hi-Kn010G3/L0000-k0 | 7.79E-08 |
| TR01H021-E22Hh/none-Hi-Kn010G3/L0000-k0 | 8.05E-08 |
| TR01H103-E22Hh/none-Hi-Kn010G3/L0011-k0 | 7.72E-08 |
| TR01H099-E22Hh/none-Hi-Kn010G3/L0011-k0 | 7.74E-08 |
| rCE115H-E22Hh/none-Hi-Kn010G3/L0000vk1-k0 | 8.52E-08 |
| TR01H101-E22Hh/none-Hi-Kn010G3/L0011-k0 | 7.87E-08 |
| TR01H053-E22Hh/none-Hi-Kn010G3/L0000-k0 | 8.23E-08 |
| TR01H035-E22Hh/none-Hi-Kn010G3/L0000-k0 | 8.49E-08 |
| TR01H067-E22Hh/none-Hi-Kn010G3/TR01L015-k0 | 8.64E-08 |
| TR01H104-E22Hh/none-Hi-Kn010G3/L0011-k0 | 8.26E-08 |
| TR01H075-E22Hh/none-Hi-Kn010G3/L0000-k0 | 9.88E-08 |
| TR01H040-E22Hh/none-Hi-Kn010G3/L0227-k0 | 1.01E-07 |
| TR01H102-E22Hh/none-Hi-Kn010G3/L0011-k0 | 8.54E-08 |
| TR01H034-E22Hh/none-Hi-Kn010G3/L0000-k0 | 9.11E-08 |
| TR01H082-E22Hh/none-Hi-Kn010G3/L0222-k0 | 1.01E-07 |
| rCE115H-E22Hh/rCE115L-k0/GL4-E22Hk/H0000-E22L | 9.37E-08 |
| TR01H015-E22Hh/none-Hi-Kn010G3/TR01L006-k0 | 9.30E-08 |
| TR01H040-E22Hh/none-Hi-Kn010G3/L0246-k0 | 9.28E-08 |
| TR01H097-E22Hh/none-Hi-Kn010G3/L0011-k0 | 8.76E-08 |
| TR01H011-E22Hh/none-Hi-Kn010G3/L0000-k0 | 3.71E-08 |
| TR01H010-E22Hh/none-Hi-Kn010G3/L0000-k0 | 3.73E-08 |
| TR01H095-E22Hh/none-Hi-Kn010G3/L0011-k0 | 9.09E-08 |
| TR01H082-E22Hh/none-Hi-Kn010G3/TR01L020-k0 | 1.06E-07 |
| TR01H098-E22Hh/none-Hi-Kn010G3/L0011-k0 | 9.14E-08 |
| TR01H082-E22Hh/none-Hi-Kn010G3/TR01L017-k0 | 1.09E-07 |
| TR01H040-E22Hh/none-Hi-Kn010G3/L0247-k0 | 1.00E-07 |
| rCE115H-E22Hh/none-Hi-Kn010G3/rCE115L-k0 | 1.24E-07 |
| TR01H004-E22Hh//-Hi-Kn010G3/L0000-k0 | 1.35E-07 |
| TR01H082-E22Hh/none-Hi-Kn010G3/L0222-k0 | 7.63E-08 |
| rCE115H-E22Hh//-Hi-Kn010G3/rCE115L-k0 | 1.38E-07 |
| TR01H008-E22Hh/none-Hi-Kn010G3/L0000-k0 | 4.22E-08 |
| TR01H070-E22Hh/none-Hi-Kn010G3/L0000-k0 | 1.20E-07 |
| TR01H106-E22Hh/none-Hi-Kn010G3/L0011-k0 | 1.00E-07 |
| TR01H024-E22Hh/none-Hi-Kn010G3/L0000-k0 | 1.08E-07 |
| CE115HA124-E22Hh//-Hi-Kn010G3/L0000-k0 | 1.43E-07 |
| TR01H040-E22Hh/none-Hi-Kn010G3/L0249-k0 | 1.11E-07 |
| TR01H082-E22Hh/none-Hi-Kn010G3/L0271-k0 | 6.82E-08 |
| TR01H057-E22Hh/none-Hi-Kn010G3/L0011-k0 | 1.12E-07 |
| TR01H058-E22Hh/none-Hi-Kn010G3/L0000-k0 | 1.15E-07 |
| TR01H068-E22Hh/none-Hi-Kn010G3/L0000-k0 | 1.01E-07 |
| TR01H082-E22Hh/none-Hi-Kn010G3/L0270-k0 | 7.42E-08 |
| TR01H082-E22Hh/none-Hi-Kn010G3/L0272-k0 | 7.44E-08 |

TABLE 12-continued

| Antibody name | KD (Human CD3) |
|---|---|
| hCE115HA-E22Hh/none-Hi-Kn010G3/L0000-k0 | 1.24E−07 |
| TR01H082-E22Hh/none-Hi-Kn010G3/L0268-k0 | 1.36E−07 |
| hCE115HAa-E22Hh/none-Hi-Kn010G3/L0000-k0 | 1.08E−07 |
| TR01H067-E22Hh/none-Hi-Kn010G3/L0226-k0 | 1.32E−07 |
| TR01H067-E22Hh/none-Hi-Kn010G3/L0248-k0 | 1.39E−07 |

(3-2) Modifying the Affinity of a Humanized Anti-GPC3 Antibody

First, point mutations were introduced into CDR1, CDR2, and CDR3 of the anti-human GPC3 bispecific antibody sequence produced in Reference Example 2, H0000-ERY27_HK (SEQ ID NO: 54), to prepare modified antibodies. Next, the affinity of these modified antibodies for soluble human GPC3 was determined. Combining sites that have an affinity-enhancing effect yielded modified antibodies having the affinities shown in Table 13.

TABLE 13

| Antibody name | KD (Human GPC3) |
|---|---|
| H0610-G1dh/none-Hi-Kn010G3/L0000-k0 | 3.97E−09 |
| H0610-G1dh/none-Hi-Kn010G3/L0222-k0 | 1.40E−13 |
| H0610-G1dh/none-Hi-Kn010G3/L0258-k0 | 3.52E−13 |
| GCH054-G1dh/none-Hi-Kn010G3/L0262-k0 | 5.25E−13 |
| GCH060-G1dh/none-Hi-Kn010G3/L0222-k0 | 6.42E−13 |
| H0610-G1dh/none-Hi-Kn010G3/L0246-k0 | 1.21E−12 |
| GCH057-G1dh/none-Hi-Kn010G3/L0222-k0 | 1.85E−12 |
| GCH054-G1dh/none-Hi-Kn010G3/L0249-k0 | 3.61E−12 |
| GCH055-G1dh/none-Hi-Kn010G3/L0222-k0 | 3.90E−12 |
| GCH094-G1dh/none-Hi-Kn010G3/L0246-k0 | 4.12E−12 |
| H0610-G1dh/none-Hi-Kn010G3/L0249-k0 | 6.86E−12 |
| H0610-G1dh/none-Hi-Kn010G3/TR01L017-k0 | 8.27E−12 |
| H0610-G1dh/none-Hi-Kn010G3/L0265-k0 | 8.70E−12 |
| H0610-G1dh/none-Hi-Kn010G3/L0261-k0 | 1.07E−11 |
| GCH065-G1dh/none-Hi-Kn010G3/L0262-k0 | 1.18E−11 |
| GCH056-G1dh/none-Hi-Kn010G3/L0262-k0 | 1.19E−11 |
| H0610-G1dh/none-Hi-Kn010G3/L0268-k0 | 1.69E−11 |
| H0610-G1dh/none-Hi-Kn010G3/TR01L020-k0 | 2.24E−11 |
| GCH054-G1dh/none-Hi-Kn010G3/L0246-k0 | 3.15E−11 |
| GCH054-G1dh/none-Hi-Kn010G3/L0222-k0 | 3.15E−11 |
| GCH073-G1dh/none-Hi-Kn010G3/L0201-k0 | 3.50E−11 |
| H0610-G1dh/none-Hi-Kn010G3/L0248-k0 | 5.55E−11 |
| GCH065-G1dh/none-Hi-Kn010G3/L0201-k0 | 7.74E−11 |
| H0610-G1dh/none-Hi-Kn010G3/L0226-k0 | 9.30E−11 |
| H0610-G1dh/none-Hi-Kn010G3/L0093-k0 | 1.06E−10 |
| GCH098-G1dh/none-Hi-Kn010G3/L0201-k0 | 1.11E−10 |
| H0610-G1dh/none-Hi-Kn010G3/L0267-k0 | 1.79E−10 |
| H0610-G1dh/none-Hi-Kn010G3/L0228-k0 | 2.02E−10 |
| H0610-G1dh/none-Hi-Kn010G3/L0262-k0 | 2.11E−10 |
| H0610-G1dh/none-Hi-Kn010G3/L0266-k0 | 2.13E−10 |
| H0610-G1dh/none-Hi-Kn010G3/L0264-k0 | 2.19E−10 |
| H0610-G1dh/none-Hi-Kn010G3/L0224-k0 | 2.43E−10 |
| H0610-G1dh/none-Hi-Kn010G3/L0167-k0 | 2.11E−10 |
| CE115HA251-E22Hh/L0000-k0/GL4-E22Hk/H0610-E22L | 2.36E−10 |
| TR01H015-E22Hh/L0000-k0/GL4-E22Hk/H0610-E22L | 2.63E−10 |
| CE115HA236-E22Hh/GLS3108-k0/GL4-E22Hk/H0610-E22L | 2.67E−10 |
| H0610-G1dh/none-Hi-Kn010G3/L0259-k0 | 3.34E−10 |
| H0610-G1dh/none-Hi-Kn010G3/L0227-k0 | 4.08E−10 |
| GCH065-G1dh/none-Hi-Kn010G3/L0272-k0 | 3.93E−10 |
| H0610-G1dh/none-Hi-Kn010G3/L0269-k0 | 4.59E−10 |
| H0610-G1dh/none-Hi-Kn010G3/L0223-k0 | 4.75E−10 |
| TR01H002-E22Hh/GLS3108-k0/GL4-E22Hk/H0610-E22L | 4.75E−10 |
| GCH054-G1dh/none-Hi-Kn010G3/L0212-k0 | 5.17E−10 |
| H0610-G1dh/none-Hi-Kn010G3/L0208-k0 | 5.30E−10 |
| H0610-G1dh/none-Hi-Kn010G3/L0263-k0 | 5.64E−10 |
| H0610-G1dh/none-Hi-Kn010G3/L0231-k0 | 5.89E−10 |
| H0610-G1dh/none-Hi-Kn010G3/L0143-k0 | 5.73E−10 |
| GCH055-G1dh/none-Hi-Kn010G3/L0212-k0 | 6.14E−10 |
| H0610-G1dh/none-Hi-Kn010G3/L0211-k0 | 6.47E−10 |

TABLE 13-continued

| Antibody name | KD (Human GPC3) |
|---|---|
| H0610-G1dh/none-Hi-Kn010G3/L0238-k0 | 6.37E−10 |
| H0610-G1dh/none-Hi-Kn010G3/L0214-k0 | 6.57E−10 |
| H0610-G1dh/none-Hi-Kn010G3/L0243-k0 | 6.49E−10 |
| GCH025-G1dh/none-Hi-Kn010G3/L0204-k0 | 6.70E−10 |
| GCH054-G1dh/none-Hi-Kn010G3/TR01L016-k0 | 7.63E−10 |
| H0610-G1dh/none-Hi-Kn010G3/L0168-k0 | 6.99E−10 |
| GCH094-G1dh/none-Hi-Kn010G3/L0271-k0 | 6.92E−10 |
| GCH054-G1dh/none-Hi-Kn010G3/TR01L019-k0 | 8.71E−10 |
| H0610-G1dh/none-Hi-Kn010G3/L0234-k0 | 7.78E−10 |
| GCH098-G1dh/none-Hi-Kn010G3/L0011-k0 | 8.02E−10 |
| H0610-G1dh/none-Hi-Kn010G3/L0204-k0 | 7.27E−10 |
| H0610-G1dh/none-Hi-Kn010G3/L0240-k0 | 8.48E−10 |
| H0610-G1dh/none-Hi-Kn010G3/L0239-k0 | 8.74E−10 |
| H0610-G1dh/none-Hi-Kn010G3/L0212-k0 | 9.94E−10 |
| GCH065-G1dh/none-Hi-Kn010G3/L0011-k0 | 8.84E−10 |
| H0610-G1dh/none-Hi-Kn010G3/L0200-k0 | 1.04E−09 |
| H0610-G1dh/none-Hi-Kn010G3/L0124-k0 | 9.72E−10 |
| GCH073-G1dh/none-Hi-Kn010G3/L0011-k0 | 9.10E−10 |
| H0610-G1dh/none-Hi-Kn010G3/TR01L016-k0 | 1.08E−09 |
| GCH054-G1dh/none-Hi-Kn010G3/L0201-k0 | 1.08E−09 |
| H0610-G1dh/none-Hi-Kn010G3/L0090-k0 | 1.12E−09 |
| H0610-G1dh/none-Hi-Kn010G3/L0209-k0 | 1.12E−09 |
| H0610-G1dh/none-Hi-Kn010G3/L0201-k0 | 1.13E−09 |
| H0610-G1dh/none-Hi-Kn010G3/L0161-k0 | 9.73E−10 |
| H0610-G1dh/none-Hi-Kn010G3/L0206-k0 | 8.65E−10 |
| H0610-G1dh/none-Hi-Kn010G3/L0186-k0 | 1.08E−09 |
| H0610-G1dh/none-Hi-Kn010G3/TR01L019-k0 | 1.15E−09 |
| H0610-G1dh/none-Hi-Kn010G3/L0085-k0 | 1.17E−09 |
| GCH055-G1dh/none-Hi-Kn010G3/L0200-k0 | 1.13E−09 |
| H0610-G1dh/none-Hi-Kn010G3/L0154-k0 | 1.01E−09 |
| H0610-G1dh/none-Hi-Kn010G3/L0229-k0 | 1.20E−09 |
| GCH054-G1dh/none-Hi-Kn010G3/L0200-k0 | 1.18E−09 |
| GCH094-G1dh/none-Hi-Kn010G3/L0201-k0 | 1.17E−09 |
| H0610-G1dh/none-Hi-Kn010G3/L0000-k0 | 3.97E−09 |
| H0610-G1dh/none-Hi-Kn010G3/L0205-k0 | 1.01E−09 |
| GCH099-G1dh/none-Hi-Kn010G3/L0201-k0 | 1.29E−09 |
| H0610-G1dh/none-Hi-Kn010G3/L0242-k0 | 1.19E−09 |
| GCH056-G1dh/none-Hi-Kn010G3/L0201-k0 | 1.16E−09 |
| H0610-G1dh/none-Hi-Kn010G3/L0213-k0 | 1.25E−09 |
| GCH060-G1dh/none-Hi-Kn010G3/L0200-k0 | 1.34E−09 |
| GCH065-G1dh/none-Hi-Kn010G3/L0000-k0 | 1.41E−09 |
| GCH100-G1dh/none-Hi-Kn010G3/L0201-k0 | 1.37E−09 |
| H0610-G1dh/none-Hi-Kn010G3/L0015-k0 | 1.31E−09 |
| H0610-G1dh/none-Hi-Kn010G3/L0151-k0 | 1.25E−09 |
| H0610-G1dh/none-Hi-Kn010G3/L0237-k0 | 1.31E−09 |
| H0610-G1dh/none-Hi-Kn010G3/L0220-k0 | 1.36E−09 |
| H0610-G1dh/none-Hi-Kn010G3/L0155-k0 | 1.28E−09 |
| GCH055-G1dh/none-Hi-Kn010G3/L0215-k0 | 1.52E−09 |
| H0610-G1dh/none-Hi-Kn010G3/L0202-k0 | 1.22E−09 |
| GCH056-G1dh/none-Hi-Kn010G3/L0215-k0 | 1.59E−09 |
| H0610-G1dh/none-Hi-Kn010G3/L0012-k0 | 1.55E−09 |
| GCH054-G1dh/none-Hi-Kn010G3/L0215-k0 | 1.62E−09 |
| H0610-G1dh/none-Hi-Kn010G3/L0215-k0 | 1.64E−09 |
| GCH098-G1dh/none-Hi-Kn010G3/L0000-k0 | 1.77E−09 |
| H0610-G1dh/none-Hi-Kn010G3/L0125-k0 | 1.71E−09 |
| GCH057-G1dh/none-Hi-Kn010G3/L0215-k0 | 1.83E−09 |
| H0610-G1dh/none-Hi-Kn010G3/L0217-k0 | 1.79E−09 |
| H0610-G1dh/none-Hi-Kn010G3/L0014-k0 | 1.82E−09 |
| H0610-G1dh/none-Hi-Kn010G3/L0216-k0 | 1.86E−09 |
| TR01H015-E2702GsKsc/GCH019-E2704sEpscL0000-k0 | 1.64E−09 |
| H0610-G1dh/none-Hi-Kn010G3/TR01L015-k0 | 2.16E−09 |
| H0610-G1dh/none-Hi-Kn010G3/TR01L018-k0 | 2.17E−09 |
| H0610-G1dh/none-Hi-Kn010G3/L0218-k0 | 1.99E−09 |
| H0610-G1dh/none-Hi-Kn010G3/L0000vk1-k0 | 2.16E−09 |
| H0610-G1dh/none-Hi-Kn010G3/L0160-k0 | 2.12E−09 |
| H0610-G1dh/none-Hi-Kn010G3/L0047-k0 | 2.23E−09 |
| GCH073-G1dh/none-Hi-Kn010G3/L0000-k0 | 2.00E−09 |
| GCH054-G1dh/none-Hi-Kn010G3/TR01L015-k0 | 2.45E−09 |
| H0610-G1dh/none-Hi-Kn010G3/L0219-k0 | 2.28E−09 |
| GCH094-G1dh/none-Hi-Kn010G3/L0272-k0 | 2.10E−09 |
| H0610-G1dh/none-Hi-Kn010G3/L0149-k0 | 2.16E−09 |
| GCH054-G1dh/none-Hi-Kn010G3/TR01L018-k0 | 2.59E−09 |
| GCH054-G1dh/none-Hi-Kn010G3/L0203-k0 | 2.48E−09 |
| H0610-G1dh/none-Hi-Kn010G3/L0122-k0 | 2.42E−09 |
| H0610-G1dh/none-Hi-Kn010G3/L0134-k0 | 2.53E−09 |
| H0610-G1dh/none-Hi-Kn010G3/L0152-k0 | 2.36E−09 |

TABLE 13-continued

| Antibody name | KD (Human GPC3) |
|---|---|
| H0610-G1dh/none-Hi-Kn010G3/L0203-k0 | 2.11E-09 |
| H0610-G1dh/none-Hi-Kn010G3/L0075-k0 | 2.85E-09 |
| H0610-G1dh/none-Hi-Kn010G3/L0038-k0 | 2.75E-09 |
| H0610-G1dh/none-Hi-Kn010G3/L0011-k0 | 2.76E-09 |
| H0610-G1dh/none-Hi-Kn010G3/L0157-k0 | 2.60E-09 |
| H0610-G1dh/none-Hi-Kn010G3/L0145-k0 | 2.66E-09 |
| H0610-G1dh/none-Hi-Kn010G3/TR01L010-k0 | 2.92E-09 |
| H0610-G1dh/none-Hi-Kn010G3/L0009-k0 | 2.99E-09 |
| GCH099-G1dh/none-Hi-Kn010G3/L0011-k0 | 2.78E-09 |
| H0610-G1dh/none-Hi-Kn010G3/L0006-k0 | 3.04E-09 |
| H0610-G1dh/none-Hi-Kn010G3/L0173-k0 | 2.83E-09 |
| H0610-G1dh/none-Hi-Kn010G3/L0127-k0 | 3.12E-09 |
| H0610-G1dh/none-Hi-Kn010G3/L0082-k0 | 3.43E-09 |
| H0610-G1dh/none-Hi-Kn010G3/L0064-k0 | 3.37E-09 |
| H0610-G1dh/none-Hi-Kn010G3/L0008-k0 | 3.30E-09 |
| H0610-G1dh/none-Hi-Kn010G3/L0013-k0 | 3.35E-09 |
| H0610-G1dh/none-Hi-Kn010G3/L0140-k0 | 3.38E-09 |
| H0610-G1dh/none-Hi-Kn010G3/L0039-k0 | 3.41E-09 |
| GCH043-G1dh/none-Hi-Kn010G3/L0000-k0 | 3.74E-09 |
| H0610-G1dh/none-Hi-Kn010G3/TR01L008-k0 | 3.48E-09 |
| H0610-G1dh/none-Hi-Kn010G3/L0148-k0 | 3.28E-09 |
| GCH062-G1dh/none-Hi-Kn010G3/L0000-k0 | 3.73E-09 |
| H0610-G1dh/none-Hi-Kn010G3/L0163-k0 | 3.38E-09 |
| H0610-G1dh/none-Hi-Kn010G3/L0233-k0 | 3.55E-09 |
| H0610-G1dh/none-Hi-Kn010G3/L0230-k0 | 4.00E-09 |
| GCH006-G1dh/none-Hi-Kn010G3/L0000-k0 | 4.06E-09 |
| H0610-G1dh/none-Hi-Kn010G3/L0032-k0 | 3.72E-09 |
| H0610-G1dh/none-Hi-Kn010G3/L0181-k0 | 3.51E-09 |
| H0610-G1dh/none-Hi-Kn010G3/TR01L009-k0 | 3.81E-09 |
| H0610-G1dh/none-Hi-Kn010G3/L0141-k0 | 3.86E-09 |
| H0610-G1dh/none-Hi-Kn010G3/L0079-k0 | 4.23E-09 |
| GCH094-G1dh/none-Hi-Kn010G3/L0270-k0 | 3.60E-09 |
| GCH066-G1dh/none-Hi-Kn010G3/L0000-k0 | 4.29E-09 |
| GCH064-G1dh/none-Hi-Kn010G3/L0000-k0 | 4.14E-09 |
| H0610-G1dh/none-Hi-Kn010G3/L0066-k0 | 4.20E-09 |
| GCH027-G1dh/none-Hi-Kn010G3/L0000-k0 | 3.83E-09 |
| H0610-G1dh/none-Hi-Kn010G3/L0003-k0 | 4.01E-09 |
| H0610-G1dh/none-Hi-Kn010G3/L0042-k0 | 4.27E-09 |
| H0610-G1dh/none-Hi-Kn010G3/TR01L011-k0 | 4.02E-09 |
| H0610-G1dh/none-Hi-Kn010G3/L0000-k0 | 3.97E-09 |
| GCH015-G1dh/none-Hi-Kn010G3/L0000-k0 | 4.14E-09 |
| H0610-G1dh/none-Hi-Kn010G3/L0175-k0 | 3.84E-09 |
| GCH100-G1dh/none-Hi-Kn010G3/L0011-k0 | 3.81E-09 |
| GCH014-G1dh/none-Hi-Kn010G3/L0000-k0 | 4.20E-09 |
| GCH053-G1dh/none-Hi-Kn010G3/L0000-k0 | 4.05E-09 |
| hCE115HA-E22Hh/L0000-k0/GL4-E22Hk/H0000-E22L | 4.28E-09 |
| GCH094-G1dh/none-Hi-Kn010G3/L0011-k0 | 3.88E-09 |
| GCH045-G1dh/none-Hi-Kn010G3/L0000-k0 | 4.63E-09 |
| H0610-G1dh/none-Hi-Kn010G3/TR01L012-k0 | 4.25E-09 |
| H0610-G1dh/none-Hi-Kn010G3/L0115-k0 | 4.34E-09 |
| H0610-G1dh/none-Hi-Kn010G3/L0044-k0 | 4.57E-09 |
| H0610-G1dh/none-Hi-Kn010G3/L0107-k0 | 4.38E-09 |
| H0610-G1dh/none-Hi-Kn010G3/L0007-k0 | 4.39E-09 |
| GCH013-G1dh/none-Hi-Kn010G3/L0000-k0 | 4.44E-09 |
| H0610-G1dh/none-Hi-Kn010G3/L0045-k0 | 4.66E-09 |
| GCH010-G1dh/none-Hi-Kn010G3/L0000-k0 | 4.12E-09 |
| GCH040-G1dh/none-Hi-Kn010G3/L0000-k0 | 4.80E-09 |
| H0610-G1dh/none-Hi-Kn010G3/L0002-k0 | 4.43E-09 |
| H0610-G1dh/none-Hi-Kn010G3/L0016-k0 | 4.44E-09 |
| GCH007-G1dh/none-Hi-Kn010G3/L0000-k0 | 4.93E-09 |
| GCH042-G1dh/none-Hi-Kn010G3/L0000-k0 | 4.89E-09 |
| rCE115H-E22Hh/rCE115L-k0/GL4-E22Hk/H0000-E22L | 4.57E-09 |
| H0610-G1dh/none-Hi-Kn010G3/L0129-k0 | 4.54E-09 |
| H0610-G1dh/none-Hi-Kn010G3/L0065-k0 | 4.79E-09 |
| GCH016-G1dh/none-Hi-Kn010G3/L0000-k0 | 4.59E-09 |
| GCH035-G1dh/none-Hi-Kn010G3/L0000-k0 | 4.94E-09 |
| GCH039-G1dh/none-Hi-Kn010G3/L0000-k0 | 4.95E-09 |
| GCH099-G1dh/none-Hi-kn010G3/L0000-k0 | 4.24E-09 |
| H0610-G1dh/none-Hi-Kn010G3/L0041-k0 | 4.85E-09 |
| GCH019-G1dh/none-Hi-Kn010G3/L0000-k0 | 4.36E-09 |
| GCH029-G1dh/none-Hi-Kn010G3/L0000-k0 | 5.01E-09 |
| GCH056-G1dh/none-Hi-Kn010G3/L0011-k0 | 4.31E-09 |
| H0610-G1dh/none-Hi-Kn010G3/L0147-k0 | 4.38E-09 |
| GCH034-G1dh/none-Hi-Kn010G3/L0000-k0 | 5.09E-09 |
| GCH003-G1dh/none-Hi-Kn010G3/L0000-k0 | 5.20E-09 |
| H0610-G1dh/none-Hi-Kn010G3/L0139-k0 | 4.78E-09 |
| H0610-G1dh/none-Hi-Kn010G3/L0089-k0 | 5.24E-09 |
| H0610-G1dh/none-Hi-Kn010G3/L0113-k0 | 4.82E-09 |
| H0610-G1dh/none-Hi-Kn010G3/L0180-k0 | 4.48E-09 |
| GCH005-G1dh/none-Hi-Kn010G3/L0000-k0 | 5.32E-09 |
| GCH067-G1dh/none-Hi-Kn010G3/L0000-k0 | 5.24E-09 |
| H0610-G1dh/none-Hi-Kn010G3/L0187-k0 | 4.92E-09 |
| H0610-G1dh/none-Hi-Kn010G3/L0043-k0 | 5.14E-09 |
| H0610-G1dh/none-Hi-Kn010G3/L0117-k0 | 4.92E-09 |
| GCH061-G1dh/none-Hi-Kn010G3/L0000-k0 | 5.13E-09 |
| GCH022-G1dh/none-Hi-Kn010G3/L0000-k0 | 4.92E-09 |
| H0610-G1dh/none-Hi-Kn010G3/L0091-k0 | 5.43E-09 |
| GCH023-G1dh/none-Hi-Kn010G3/L0000-k0 | 4.94E-09 |
| H0610-G1dh/none-Hi-Kn010G3/L0062-k0 | 5.28E-09 |
| H0610-G1dh/none-Hi-Kn010G3/L0136-k0 | 5.04E-09 |
| H0610-G1dh/none-Hi-Kn010G3/TR01L003-k0 | 5.08E-09 |
| H0610-G1dh/none-Hi-Kn010G3/L0069-k0 | 5.32E-09 |
| H0610-G1dh/none-Hi-Kn010G3/L0123-k0 | 5.08E-09 |
| GCH025-G1dh/none-Hi-Kn010G3/L0000-k0 | 5.05E-09 |
| GCH100-G1dh/none-Hi-Kn010G3/L0000-k0 | 5.39E-09 |
| H0610-G1dh/none-Hi-Kn010G3/L0046-k0 | 5.45E-09 |
| H0610-G1dh/none-Hi-Kn010G3/L0144-k0 | 4.84E-09 |
| GCH026-G1dh/none-Hi-Kn010G3/L0000-k0 | 5.17E-09 |
| H0610-G1dh/none-Hi-Kn010G3/L0138-k0 | 5.24E-09 |
| GCH056-G1dh/none-Hi-Kn010G3/L0000-k0 | 5.03E-09 |
| H0610-G1dh/none-Hi-Kn010G3/L0129-k0 | 5.28E-09 |
| GCH032-G1dh/none-Hi-Kn010G3/L0000-k0 | 5.74E-09 |
| H0610-G1dh/none-Hi-Kn010G3/TR01L005-k0 | 5.37E-09 |
| GCH012-G1dh/none-Hi-Kn010G3/L0000-k0 | 5.40E-09 |
| GCH055-G1dh/none-Hi-Kn010G3/L0000-k0 | 5.60E-09 |
| H0610-G1dh/none-Hi-Kn010G3/L0104-k0 | 5.90E-09 |
| GCH059-G1dh/none-Hi-Kn010G3/L0000-k0 | 5.70E-09 |
| GCH054-G1dh/none-Hi-Kn010G3/L0000-k0 | 5.30E-09 |
| GCH008-G1dh/none-Hi-Kn010G3/L0000-k0 | 5.55E-09 |
| H0610-G1dh/none-Hi-Kn010G3/L0232-k0 | 5.38E-09 |
| H0610-G1dh/none-Hi-Kn010G3/L0126-k0 | 5.62E-09 |
| GCH094-G1dh/none-Hi-Kn010G3/L0000-k0 | 5.89E-09 |
| H0610-G1dh/none-Hi-Kn010G3/L0132-k0 | 5.65E-09 |
| H0610-G1dh/none-Hi-kn010G3/L0106-k0 | 5.66E-09 |
| GCH054-G1dh/none-Hi-Kn010G3/L0011-k0 | 5.25E-09 |
| H0610-G1dh/none-Hi-Kn010G3/L0109-k0 | 5.70E-09 |
| H0610-G1dh/none-Hi-Kn010G3/L0063-k0 | 6.03E-09 |
| GCH068-G1dh/none-Hi-Kn010G3/L0000-k0 | 6.23E-09 |
| GCH057-G1dh/none-Hi-Kn010G3/L0000-k0 | 5.61E-09 |
| H0610-G1dh/none-Hi-kn010G3/L0137-k0 | 5.87E-09 |

(3-3) Modification of pI by Point Mutations

In commercial production of bispecific antibodies, a high level of purity is required. When using ion-exchange chromatography, modifying the molecular isoelectric point (pI) has been reported to be effective (PLoS One. 2013; 8(2): e57479). Therefore, point mutations for pI modifications were introduced into CDR1, CDR2, and CDR3 of the humanized anti-human GPC3 antibody sequence produced in Reference Example 2, H0000-ERY27_HK (SEQ ID NO: 54), to prepare modified antibodies. Next, the affinity of these modified antibodies for soluble human GPC3 was determined.

As a result, amino acid modifications that can lower the pI while maintaining the affinity for human GPC3 were found to be amino acids at positions 19, 43, 53, and 61 according to Kabat numbering.

Combination of sites showing effects of maintaining the affinity for human GPC3 and lowering the pI yielded antibodies having the affinities and pI values shown in Table 14.

TABLE 14

| Antibody name (homomeric antibody) | Calculated pI value (homomeric antibody) | Antibody name (single-arm antibody) | human GPC3 KD (single-arm antibody) | Mutation sites based on H0610-E2704sEpsc |
|---|---|---|---|---|
| H0610-E2704sEpsc/L0000-k0 | 7.8 | H0610-G1dh/none-Hi-Kn010G3/L0000-K0 | 4.16E−09 | — |
| GCH054-E2704sEpsc/L0011-k0 | 6.2 | GCH054-G1dh/none-Hi-Kn010G3/L0011-k0 | 5.25E−09 | K19T/Q43E/P52aG/K53E/G55P/Q61E |
| GCH065-E2704sEpsc/L0011-k0 | 6.4 | GCH065-G1dh/none-Hi-Kn010G3/L0011-k0 | 8.84E−10 | K19T/Q43E/P52aG/K53P/G55P/Q61E |
| GCH094-E2704sEpsc/L0011-k0 | 6.2 | GCH094-G1dh/none-Hi-Kn010G3/L0011-K0 | 4.54E−09 | K19T/I37V/P40A/Q43E/I48M/P52aG/K53E/G55P/Q61E |

(3-4) Modifying the Extracellular Matrix-Binding Ability by Point Mutation

It has been reported that non-specific binding to the extracellular matrix (ECM) and such may have effects on pharmacokinetics (MAbs. 2012 November-December; 4(6): 753-60). Therefore, the ECM-binding ability of the modified antibodies obtained in the Reference Examples was determined by the method described in Reference Example 8. As a result, the humanized anti-human CD3ε chain and anti-human GPC3 bispecific antibody, GPC3_ERY27_hCE115 (SEQ ID NOs: 54, 55, and 56), were confirmed to have high ECM-binding abilities. Therefore, any of the point mutations examined in Reference Examples 3-1, 3-2, and 3-3 for the humanized anti-human CD3ε chain antibody sequence hCE115HA-ERY27_HE (SEQ ID NO: 55) was investigated to be a combination for reducing the ECM-binding ability. As a result, amino acids at positions 11, 16, 52a, 53, 98, and 100 by Kabat numbering were found to contribute to the maintenance of affinity for CD3ε and to have influence on the reduction of the ECM-binding ability, and antibodies with a reduced ECM-binding ability in comparison to that of an antibody variant of the humanized anti-human CD3ε chain and anti-human GPC3 bispecific antibody, GPC3_ERY27_hCE115, were obtained (Table 15).

TABLE 15

| Antibody name | ECM binding ratio (standard = 1) |
|---|---|
| GPC3_ERY22_CE115 (rCE115H-E22Hh/rCE115L-k0/GL4-E22Hk/H0000-E22L) | 4.0 |
| GPC3_ERY27 (hCE115HA-E22Hh/L0000-k0/GL4-E22Hk/H0000-E22L) | 50.9 |
| CE115HA236-E22Hh/GLS3108-k0/GL4-E22Hk/H0610-E22L | 429.9 |
| CE115HA236-E22Hh/GLS3108-k0/GL4-E22Hk/H0000-E22L | 414.8 |
| CE115HA251-E22Hh/L0000-k0/GL4-E22Hk/H0000-E22L | 346.9 |
| CE115HA251-E22Hh/L0000-k0/GL4-E22Hk/H0610-E22L | 334.4 |
| TR01H002-E22Hh/GLS3108-k0/GL4-E22Hk/H0610-E22L | 301.1 |
| TR01H002-E22Hh/GLS3108-k0/GL4-E22Hk/H0000-E22L | 216.9 |
| TR01H015-E22Hh/L0000-k0/GL4-E22Hk/H0610-E22L | 185.7 |
| TR01H040-E2702GsKsc/H0610-E2704sEpsc/L0208-k0 | 50.4 |
| CE115HA122-E22Hh/L0000-k0/GL4-E22Hk/H0000-E22L | 47.0 |
| TR01H040-E2702GsKsc/H0610-E2704sEpsc/L0211-k0 | 15.5 |
| TR01H040-E2702GsKsc/H0610-E2704sEpsc/L0206-k0 | 15.4 |
| TR01H040-E2702GsKsc/H0610-E2704sEpsc/L0209-k0 | 7.4 |
| rCE115H-E22Hh/rCE115L-k0/GL4-E22Hk/H0610-E22L | 4.6 |
| TR01H040-E2702GsKsc/H0610-E2704sEpsc/L0204-k0 | 4.4 |
| TR01H067-E2702GsKsc/GCH054-E2704sEpsc/L0212-k0 | 3.3 |

TABLE 15-continued

| Antibody name | ECM binding ratio (standard = 1) |
|---|---|
| TR01H113-E2702GsKsc/GCH065-E2704sEpsc/L0011-k0 | 2.5 |
| TR01H082-E2702GsKsc/GCH065-E2704sEpsc/L0011-k0 | 1.7 |
| TR01H113-E2702GsKsc/GCH094-E2704sEpsc/L0011-k0 | 1.6 |
| rCE115H-E22Hh/rCE115L-k0/L0000-E22Hk/H0610-E22L | 1.4 |
| TR01H084-E2702GsKsc/GCH065-E2704sEpsc/L0011-k0 | 1.3 |
| TR01H084-E2702GsKsc/GCH094-E2704sEpsc/L0011-k0 | 1.2 |
| TR01H082-E2702GsKsc/GCH094-E2704sEpsc/L0201-k0 | 1.1 |
| TR01H040-E2702GsKsc/H0610-E2704sEpsc/L0000-k0 | 0.8 |
| TR01H040-E2702GsKsc/H0610-E2704sEpsc/L0201-k0 | 0.8 |
| TR01H040-E2702GsKsc/H0610-E2704sEpsc/L0203-k0 | 0.8 |
| TR01H082-E2702GsKsc/GCH094-E2704sEpsc/L0011-k0 | 0.7 |
| TR01H109-E2702GsKsc/GCH065-E2704sEpsc/L0011-k0 | 0.7 |
| TR01H067-E2702GsKsc/GCH054-E2704sEpsc/L0222-k0 | 0.6 |
| TR01H067-E2702GsKsc/GCH054-E2704sEpsc/L0201-k0 | 0.5 |
| TR01H109-E2702GsKsc/GCH094-E2704sEpsc/L0011-k0 | 0.4 |
| TR01H113-E2702GsKsc/GCH065-E2704sEpsc/L0011-k0 | 0.3 |
| MRAH-G1d/MRAL-k0(standard) | 1 |

(3-5) Modifying the Binding Ability to the SuRe™ Ligand by Point Mutations

An example where the binding of an antibody to Protein A depends on its variable region sequence (VH3) is known (J Biomol Tech. 2011 July; 22(2):50-2). In the Protein A purification of the humanized anti-human CD3ε chain and anti-human GPC3 bispecific antibody, removal of the homomeric anti-CD3 antibody is important for suppressing non-specific reactions via CD3. Therefore, it is considered desirable to suppress the binding of the homomeric anti-CD3 antibody to Protein A. Presumably, the SuRe™ ligand will be used in commercial production, and thus point mutations for SuRe™ ligand binding were introduced into CDR2 of the humanized anti-CD3 antibody H-chain variants, TR01H082-E2702GsKsc and TR01H084-E2702GsKsc (SEQ ID NO: 398 and 399), to prepare modified antibodies. The binding ability of these modified antibodies to the SuRe™ ligand was determined by the method described in Reference Example 9. As a result, amino acids at positions 19, 57, and 59 by Kabat numbering were found to contribute to the maintenance of the affinity for CD3ε and to have influence on the Sure™ ligand-binding ability, and antibodies with a reduced Sure™ ligand-binding ability in comparison to that of TR01H082-E2702GsKsc/L0011-k0 (SEQ ID NOs: 398 and 410) or TR01H084-E2702GsKsc/L0011-k0 (SEQ ID NOs: 399 and 410) were obtained (Table 16).

TABLE 16

| Antibody name | SuRe™ binding (RU) | Mutation sites based on CE115HA000 |
|---|---|---|
| TR01H084-E2702GsKsc/L0011-k0 | 5065.8 | R16G/A52aD/N53Q/D72A/L78I/G98A/Y100G/A102I |
| TR01H082-E2702GsKsc/L0011-k0 | 4469.2 | V11L/A52aD/N53Q/G98A/Y100G |
| TR01H090-E2702GsKsc/L0011-k0 | 3606.3 | V11L/R16G/A52aD/N53Q/G98A/Y100G |
| TR01H093-E2702GsKsc/L0011-k0 | 2459.7 | V11L/A52aD/N53Q/K64Q/G98A/Y100G |
| TR01H094-E2702GsKsc/L0011-k0 | 2351.9 | V11L/A52aD/N53Q/K64S/G98A/Y100G |
| TR01H114-E2702GsKsc/L0011-k0 | 1485.5 | R16G/A52aD/N53Q/T57S/D72A/L78I/G98A/Y100G/A102I |
| TR01H092-E2702GsKsc/L0011-k0 | 1159.5 | V11L/A52aD/N53Q/K64Q/G98A/Y100G |
| TR01H100-E2702GsKsc/L0011-k0 | 383.0 | V11L/A52aD/N53Q/T57S/G98A/Y100G |
| TR01H111-E2702GsKsc/L0011-k0 | 50.7 | R16G/R19K/A52aD/N53Q/D72A/L78I/G98A/Y100G/A102I |
| TR01H110-E2702GsKsc/L0011-k0 | 29.5 | R19K/A52aD/N53Q/G98A/Y100G |
| TR01H091-E2702GsKsc/L0011-k0 | 27.5 | V11L/R19K/A52aD/N53Q/G98A/Y100G |
| TR01H091-E2702GsKsc/L0011-k0 | 15.0 | V11L/R19K/A52aD/N53Q/G98A/Y100G |
| TR01H112-E2702GsKsc/L0011-k0 | 8.8 | R16G/A52aD/N53Q/T57Q/D72A/L78I/G98A/Y100G/A102I |
| TR01H113-E2702GsKsc/L0011-k0 | 7.0 | R16G/A52aD/N53Q/Y59V/D72A/L78I/G98A/Y100G/A102I |
| TR01H096-E2702GsKsc/L0011-k0 | 2.7 | V11L/A52aD/N53Q/T57G/G98A/Y100G |
| TR01H109-E2702GsKsc/L0011-k0 | 2.2 | V11L/A52aD/N53Q/Y59V/G98A/Y100G |
| TR01H098-E2702GsKsc/L0011-k0 | 1.6 | V11L/A52aD/N53Q/T57P/G98A/Y100G |
| TR01H107-E2702GsKsc/L0011-k0 | 1.4 | V11L/A52aD/N53Q/Y59Q/G98A/Y100G |
| TR01H103-E2702GsKsc/L0011-k0 | 1.4 | V11L/A52aD/N53Q/Y59G/G98A/Y100G |
| TR01H104-E2702GsKsc/L0011-k0 | 1.0 | V11L/A52aD/N53Q/Y59I/G98A/Y100G |
| TR01H105-E2702GsKsc/L0011-k0 | 0.8 | V11L/A52aD/N53Q/Y59L/G98A/Y100G |
| TR01H099-E2702GsKsc/L0011-k0 | 0.6 | V11L/A52aD/N53Q/T57Q/G98A/Y100G |
| TR01H102-E2702GsKsc/L0011-k0 | 0.5 | V11L/A52aD/N53Q/Y59F/G98A/Y100G |
| TR01H101-E2702GsKsc/L0011-k0 | 0.5 | V11L/A52aD/N53Q/T57V/G98A/Y100G |
| TR01H108-E2702GsKsc/L0011-k0 | 0.4 | V11L/A52aD/N53Q/Y59T/G98A/Y100G |
| TR01H097-E2702GsKsc/L0011-k0 | 0.1 | V11L/A52aD/N53Q/T57L/G98A/Y100G |
| TR01H106-E2702GsKsc/L0011-k0 | 0.0 | V11L/A52aD/N53Q/Y59P/G98A/Y100G |
| TR01H095-E2702GsKsc/L0011-k0 | −0.2 | V11L/A52aD/N53Q/T57F/G98A/Y100G |

(3-6) Production of Optimized Bispecific Antibodies by Combining Point Mutations that Lead to Improvement of Various Properties Optimized modified antibodies can be produced by combining the point mutations that lead to improvement of various properties as described in Reference Examples 3-1 to 3-5. As examples of such modified antibodies, the antibodies described in Table 17 were produced, and they were subjected to the T-cell-dependent cellular cytotoxicity (TDCC) evaluation using methods similar to those of Reference Example 1. The results are shown in FIGS. 15 to 20. As a result, optimized humanized anti-human CD3ε chain and anti-human GPC3 bispecific antibodies showing a T-cell-dependent cellular cytotoxicity equivalent to or greater than that of GPC3_ERY22_rCE115 prior to humanization were obtained.

TABLE 17

Sample number in TDCC assay, and abbreviation of antibody name in drug efficacy evaluation

| Sample number in TDCC assay | Abbreviation of antibody name |
|---|---|
| 1 | GPC3_ERY22_CE115 (rCE115H-E22Hh/rCE115L-k0/GL4-E22Hk/H0000-E22L) |
| 2 | GPC3_ERY27 (hCE115HA-E22Hh/L0000-k0/GL4-E22Hk/H0000-E22L) |
| 3 | CE115HA251-E22Hh/L0000-k0/GL4-E22Hk/H0000-E22L |
| 4 | CE115HA236-E22Hh/GLS3108-k0/GL4-E22Hk/H0000-E22L |
| 5 | TR01H002-E22Hh/GLS3108-k0/GL4-E22Hk/H0000-E22L |
| 6 | CE115HA122-E22Hh/L0000-k0/GL4-E22Hk/H0000-E22L |
| 7 | rCE115H-E22Hh/rCE115L-k0/L0000-E22Hk/H0610-E22L |
| 8 | rCE115H-E22Hh/rCE115L-k0/GL4-E22Hk/H0610-E22L |
| 13 | TR01H040-E2702GsKsc/H0610-E2704sEpsc/L0000-k0 |
| 14 | TR01H040-E2702GsKsc/H0610-E2704sEpsc/L0201-k0 |
| 15 | TR01H040-E2702GsKsc/H0610-E2704sEpsc/L0203-k0 |
| 16 | TR01H040-E2702GsKsc/H0610-E2704sEpsc/L0204-k0 |

TABLE 17-continued

Sample number in TDCC assay, and abbreviation of antibody name in drug efficacy evaluation

| Sample number in TDCC assay | Abbreviation of antibody name |
|---|---|
| 17 | TR01H040-E2702GsKsc/H0610-E2704sEpsc/L0206-k0 |
| 18 | TR01H040-E2702GsKsc/H0610-E2704sEpsc/L0208-k0 |
| 19 | TR01H040-E2702GsKsc/H0610-E2704sEpsc/L0209-k0 |
| 20 | TR01H040-E2702GsKsc/H0610-E2704sEpsc/L0211-k0 |
| 21 | rCE115H-E2702GsKsc/H0610-E2704sEpsc/L0000-k0 |
| 22 | TR01H061-E2702GsKsc/H0610-E2704sEpsc/L0000-k0 |
| 23 | TR01H068-E2702GsKsc/H0610-E2704sEpsc/L0000-k0 |
| 24 | TR01H071-E2702GsKsc/H0610-E2704sEpsc/L0000-k0 |
| 25 | TR01H067-E2702GsKsc/GCH054-E2704sEpsc/L0201-k0 |
| 26 | TR01H067-E2702GsKsc/GCH054-E2704sEpsc/L0212-k0 |
| 27 | TR01H067-E2702GsKsc/GCH054-E2704sEpsc/L0222-k0 |
| 28 | TR01H067-E2702GsKsc/GCH054-E2704sEpsc/L0000-k0 |
| 29 | TR01H082-E2702GsKsc/GCH094-E2704sEpsc/L0201-k0 |
| 30 | TR01H082-E2702GsKsc/GCH094-E2704sEpsc/L0011-k0 |
| 31 | TR01H084-E2702GsKsc/GCH094-E2704sEpsc/L0011-k0 |
| 32 | TR01H084-E2702GsKsc/GCH065-E2704sEpsc/L0011-k0 |
| 33 | TR01H082-E2702GsKsc/GCH065-E2704sEpsc/L0011-k0 |
| 34 | TR01H109-E2702GsKsc/GCH094-E2704sEpsc/L0011-k0 |
| 35 | TR01H109-E2702GsKsc/GCH065-E2704sEpsc/L0011-k0 |
| 36 | TR01H113-E2702GsKsc/GCH094-E2704sEpsc/L0011-k0 |
| 37 | TR01H113-E2702GsKsc/GCH065-E2704sEpsc/L0011-k0 |
| 38 | TR01H113-E2702sKsc/GCH065-E2704sEpsc/L0011-k0 |

Reference Examples 3-1 to 3-6 showed that the following amino acid residues, for example, are important for maintaining the properties of the optimized anti-human CD3ε chain and anti-human GPC3 bispecific antibodies showing a T-cell-dependent cellular cytotoxicity equivalent to or greater than that of GPC3_ERY22_rCE115 prior to humanization.

In anti-human CD3ε chain antibodies, the examples are Leu at position 11, Gly at position 16, Asp at position 52a, Gln at position 53, Ala at position 72, Ile at position 78, Ala at position 98, Gly at position 100, and Ile at position 102.

In anti-human GPC3 antibodies, the examples are Thr at position 19, Glu at position 43, Gly at position 52a, Pro or Glu at position 53, Pro at position 55, and Glu at position 61. Furthermore, in common antibody L chains, the examples are Pro at position 25, Pro at position 27a, Pro at position 27b, Ile at position 33, Gln at position 34, Arg or Trp at position 56, and Tyr at position 89. (All positions are indicated by Kabat numbering).

[Reference Example 4] Evaluation of the In Vivo Efficacy

Some of the above-described antibodies were evaluated for their in vivo efficacy using tumor-bearing models.

Evaluation of the in vivo efficacy was carried out on representative antibodies from among those shown in Table 17, which have been confirmed to have cytotoxic activities from the in vitro assay described in Reference Example 3-6. In the in vivo efficacy evaluation, any influence caused by differences in the microenvironment due to tumor aggregate formation on the evaluation results was taken into consideration. Therefore, two types of human cancer cell lines having different sensitivities to the antibody drug efficacy, i.e., PC-10 and NCI-H446, were used for the evaluation, even though the GPC3 expression levels of these cell lines were nearly equal. The cell lines were transplanted into the NOD scid mice, and the NOD scid mice with confirmed tumor establishment were subjected to injection of T cells grown by in vitro culturing of human PBMCs. The mice (referred to as a T-cell injected model) were treated by administration of the optimized anti-human CD3ε chain and anti-human GPC3 bispecific antibodies.

More specifically, in drug efficacy tests of the optimized anti-human CD3ε chain and anti-human GPC3 bispecific antibodies using the PC-10 T-cell injected model, the tests below were performed. T cells were expansively cultured using PBMCs separated from blood collected from healthy volunteers and T cell activation/expansion kit/human (MACS Miltenyi biotec). The human cancer cell line PC-10 ($1 \times 10^7$ cells) was mixed with Matrigel™ Basement Membrane Matrix (BD), and transplanted to the inguinal subcutaneous region of NOD scid mice (CLEA Japan, female, 6W). The day of transplantation was defined as day 0. On the day before transplantation, the anti-asialo-GM1 antibody (Wako Pure Chemicals) was administered intraperitoneally to the mice at 0.2 mg/mouse. On days 13 to 15 after the transplantation, the mice were separated into groups according to their body weight and tumor size, and the anti-asialo-GM1 antibody was administered again intraperitoneally to the mice at 0.2 mg/mouse. On the following day, T cells obtained by the aforementioned expansive culturing were transplanted intraperitoneally at $3 \times 10^7$ cells/mouse. Four hours after T-cell transplantation, the optimized anti-human CD3ε chain and anti-human GPC3 bispecific antibodies were administered intravenously through the caudate vein at 1 mg/kg. The optimized anti-human CD3ε chain and anti-human GPC3 bispecific antibodies were administered only once.

Figure 21:
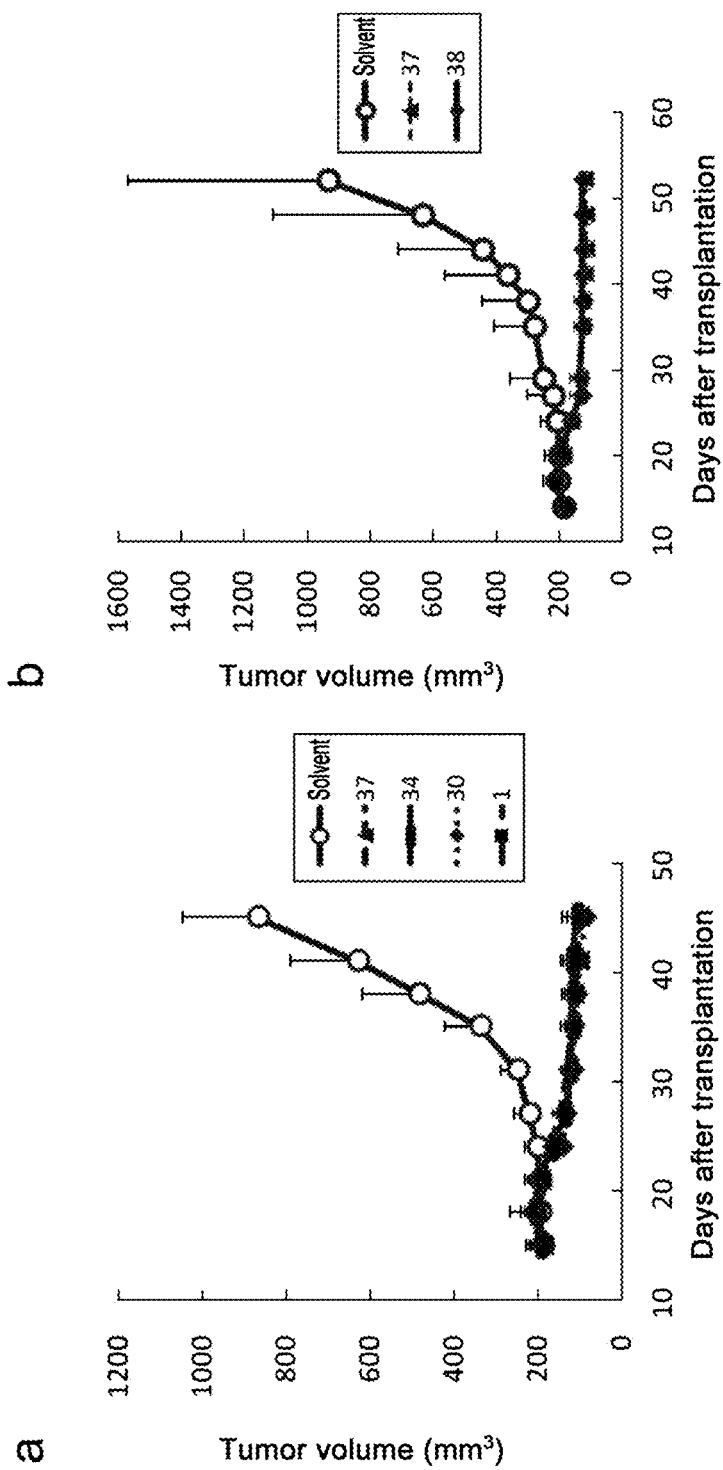
FIG. 21 shows the in vivo antitumor effects of optimized antibodies (a) 37, 34, 30 and 1, and (b) 37 and 38 when PC-10 is used as the target cell. The optimized antibodies are described in Table 17.

As a result, anti-tumor activities were more clearly observed in the optimized anti-human CD3ε chain and anti-human GPC3 bispecific antibody-administered group than in the solvent-administered group (FIG. 21a, b).

Drug efficacy tests for the optimized anti-human CD3ε chain and anti-human GPC3 bispecific antibodies on the NCI-H446 T-cell injected model were performed by similar methods. The optimized anti-human CD3ε chain and anti-human GPC3 bispecific antibodies were administered once intravenously through the caudate vein at 5 mg/kg against NCI-H446.

Figure 22:
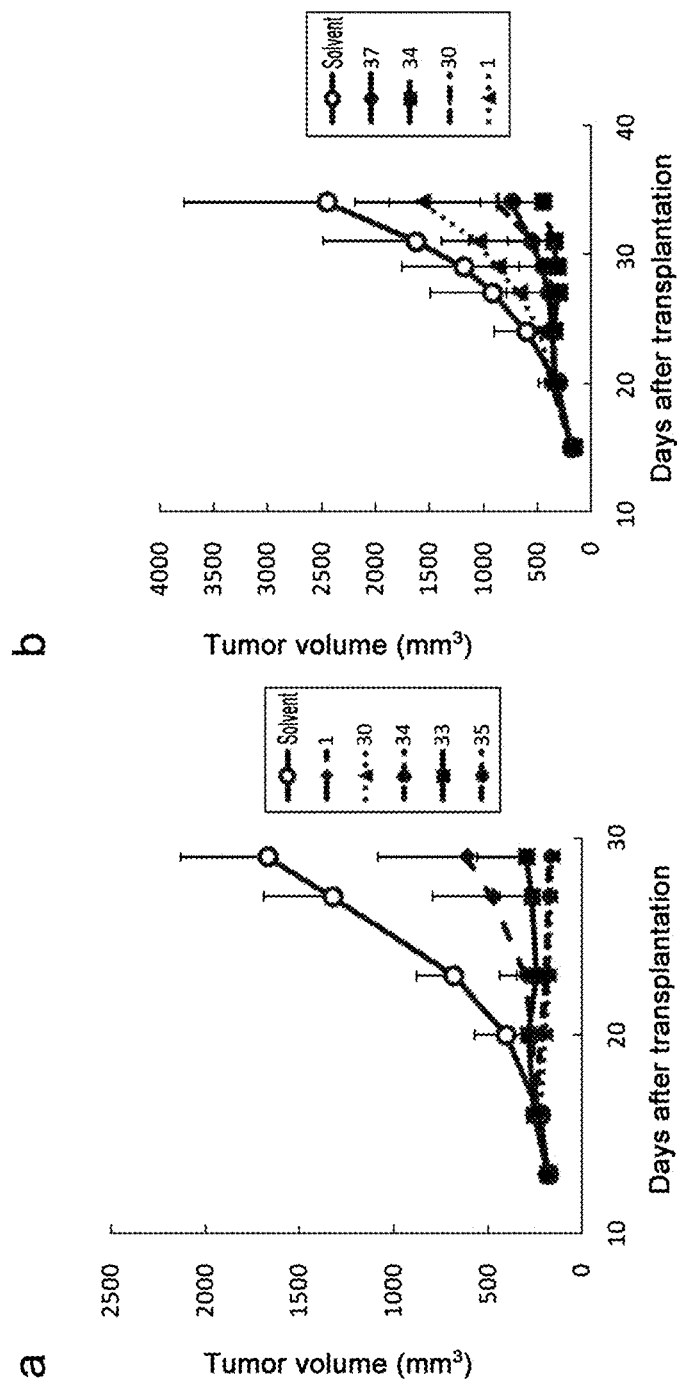
FIG. 22 shows the in vivo antitumor effects of optimized antibodies (a) 1, 30, 34, 33 and 35, and (b) 37, 34, 30 and 1 when NCI-H446 is used as the target cell. The optimized antibodies are described in Table 17.

As a result, anti-tumor activities were more clearly observed in the optimized anti-human CD3ε chain and anti-human GPC3 bispecific antibody-administered group than in the solvent-administered group (FIG. 22a, b).

[Reference Example 5] Production of Antibody Expression Vectors, and Antibody Expression and Purification Amino acid substitutions were introduced by methods known to those skilled in the art such as using the QuikChange Site-Directed Mutagenesis Kit (Stratagene), PCR, or the In-fusion Advantage PCR cloning kit (TAKARA) to construct expression vectors. Nucleotide sequences of the obtained expression vectors were determined by a method known to those skilled in the art. The produced plasmids were transiently introduced into cells of the human embryonic kidney cancer-derived cell line HEK293H (Invitrogen) or FreeStyle293 (Invitrogen) to express antibodies. From the obtained culture supernatants, antibodies were purified using the rProtein A Sepharose™ Fast Flow (GE Healthcare) by a method known to those skilled in the art. Absorbance at 280 nm of the purified antibody solutions was measured using a spectrophotometer, and antibody concentrations were calculated from the determined values using an absorption coefficient calculated by the PACE method (Protein Science 1995; 4: 2411-2423).

[Reference Example 6] the ADCC Activity of Each Test Antibody Using Human Peripheral Blood Mononuclear Cells as the Effector Cell The ADCC activity of each test antibody was determined according to the method below.

Human peripheral blood mononuclear cells (hereinafter referred to as human PBMC) were used as the effector cell to measure the ADCC activity of each test antibody as below.

(1) Preparation of a Human PBMC Solution

From a healthy volunteer (adult male) of Chugai Pharmaceutical Co. Ltd., 50 mL of peripheral blood was collected using a syringe preloaded with 200 μL of a 1000 unit/mL heparin solution (Novo-Heparin Injection 5000 units, Novo Nordisk). The peripheral blood was diluted two-fold with PBS(−), divided into four aliquots, and added into a Leucosep lymphocyte separation tube (Greiner Bio-one) that had been loaded with 15 mL of Ficoll-Paque PLUS and subjected to centrifugation in advance. This separation tube containing aliquots of peripheral blood was centrifuged at 2150 rpm for ten minutes at room temperature, and then the mononuclear cell fraction was collected. The cells in each fraction were washed once with Dulbecco's Modified Eagle's Medium (SIGMA) containing 10% FBS (hereinafter referred to as 10% FBS/D-MEM) and then suspended in 10% FBS/D-MEM at a cell density of $5 \times 10^6$ cells/mL. After incubation in an incubator at 37° C. for one hour, the cells were washed once with 10% FBS/D-MEM, and the cells were suspended in 10% FBS/D-MEM to produce a cell density of $2 \times 10^5$ cells/mL. The cell suspension was subjected to the experiment below as the target cell.

(2) Chromium Release Assay (ADCC Activity)

The ADCC activity was evaluated from the specific chromium release rate according to the chromium release method. First, antibody solutions prepared at each concentration (0, 0.004, 0.04, 0.4, 4, and 40 μg/mL) were added to a 96-well U-bottomed plate at 50 μL per well. Next, the target cells were seeded at 50 μL per well (1×10$^4$ cells/well), and this was allowed to stand at room temperature for 15 minutes. The human PBMC solution prepared in (1) was added at 100 μL per well (5×10$^5$ cells/well), and the plate was left to stand in a 5% carbon dioxide gas incubator at 37° C. for four hours, followed by centrifugation. The radioactivity of 100 μL of culture supernatant in each well of the plate was measured using a gamma counter. The specific chromium release rate was determined based on the following equation: Specific chromium release rate (%)=(A−C)× 100/(B−C)

In this equation, A represents the mean value of radioactivity (cpm) of 100 μL of culture supernatant in each well; B represents the mean value of radioactivity (cpm) of 100 μL of culture supernatant in the well where 100 μL of a 2% aqueous NP-40 solution (Nonidet P-40, Nacalai Tesque) and 50 μL of 10% FBS/D-MEM had been added to the target cells; and C represents the mean value of radioactivity (cpm) of 100 μL of culture supernatant in the well where 150 μL of 10% FBS/D-MEM had been added to the target cells. The examinations were performed in triplicate and the mean values and standard deviations of the specific chromium release rates (%) in the above-mentioned examination reflecting the ADCC activity were calculated for each of the test antibodies.

[Reference Example 7] Assessment of Tm of the Modified Antibodies by Differential Scanning Fluorimetry In this examination, the Tm (thermal denaturation temperature) value of the modified antibodies was assessed by differential scanning fluorimetry using Rotor-Gene Q (QIAGEN). It has been reported that this method has a favorable correlation with Tm assessment using a differential scanning calorimeter widely known as a method for evaluating thermal stability of antibodies (Journal of Pharmaceutical Science 2010; 4: 1707-1720).

The 5000×-concentrated SYPRO™ orange (Molecular Probes) was diluted with PBS (Sigma), and then admixed with the antibody solutions to prepare measurement samples. Twenty-μL aliquots of each sample were placed into measurement tubes, and the temperature was increased from 30° C. to 99° C. at a temperature elevation rate of 240° C./hr. Changes in fluorescence accompanying the temperature elevation were detected at 470 nm (excitation wavelength)/555 nm (fluorescence wavelength).

The data were analyzed using the Rotor-Gene Q Series software (QIAGEN) to calculate the temperature at which fluorescence transition was observed, and this temperature was defined as the Tm.

[Reference Example 8] Assessment of the ECM-Binding Ability

The assessment was carried out according to the method described in W2012093704. Specifically, BD Matrigel (BD Biosciences, #356237) was prepared at 2 mg/mL using TBS (Takara, #T903), and this was dispensed into a 96-well measurement plate (Meso Scale Discovery, #L15XB-3(High Bind)) at 5 μL per well and then allowed to stand overnight in a cool place. Then, 150 μL of an ECL blocking buffer (PBS containing 0.05% Tween20, 0.5% BSA, and 0.01% sodium azide) was dispensed into each well of the plate, and this was allowed to stand at room temperature for two hours or more.

A goat anti-human IgG(γ) (Invitrogen, #628400) was ruthenium-labeled with MSD SULFO-TAG NHS Ester (Meso Scale Discovery, #R91AN-2) by following the attached instructions. This was diluted in an ECL dilution buffer (PBS containing 0.01% Tween20, 0.1% BSA, and 0.01% sodium azide) to have a final concentration of 2 μg/mL. Furthermore, the standard antibody and the test antibodies were diluted in PBS-T (PBS containing 0.05% Tween 20 and 0.01% sodium azide) to have a final concentration of 3 μg/mL.

To a 96-well reaction plate (Thermo scientific, Nunc #145399), 10 μL of the ECL dilution buffer, 20 μL of the standard antibody and test antibody (3 μg/mL), and 30 μL of the ruthenium-labeled antibody (2 μg/mL) were added sequentially, and this was allowed to react for one hour at room temperature with stirring in the dark.

The ECL blocking buffer was removed from the 96-well measurement plate by tilting, 50 μL of the sample solution from the 96-well reaction plate was added, and this was allowed to stand in the dark at room temperature for one hour. This was followed by removal of the sample solution from the 96-well measurement plate by tilting, and immediately after addition of 150 μL of 2×T buffer (4×MSD Read Buffer T (Meso Scale Discovery) diluted two-fold using the ECL dilution buffer), ECL measurements were taken. SECTOR Imager 2400 (Meso Scale Discovery) was used for taking the measurements.

Analyses were carried out by dividing the fluorescence intensity of the test antibody by the fluorescence intensity of the standard antibody to calculate and compare the intensities by defining the value for the standard antibody to be 1.

[Reference Example 9] Assessment of the SuRe™ Ligand-Binding Ability

The ability to bind to the SuRe™ ligand was assessed by using Biacore™-T200 (GE Healthcare Japan). HBS-EP+ (GE Healthcare Japan) was used for the running buffer, and an amine coupling kit (GE Healthcare Japan) was used to covalently bind the Mab Select SuRe™ Ligand (GE Healthcare Japan) to the CM5 chip (carboxymethyl dextran-coated chip). The antibody used as the analyte was prepared at 5 μg/mL using HBS-EP+. Measurements were carried out by first injecting the 5-μg/mL antibody solution at a flow rate of 10 μL/min for 3 minutes, then switching to HBS-EP+, and measuring the response (RU) after allowing the flow to continue for 0.5 minutes. After completion of the measurements, the sensor chip was regenerated by washing with 10 mM Gly-HCl at pH 1.5. For the control flow cell, a similar experiment was performed without covalent bonding of the ligand to the chip, and the affinity for the SuRe™ ligand was analyzed by taking the difference between the responses (RU).

Sequences corresponding to the SEQ ID NOs mentioned in the Reference Examples are shown in the Table below.

TABLE 18

| SEQ ID NO: | Name |
|---|---|
| 1 | GPC3 nucleotide sequence (NM_001164617.1) |
| 2 | GPC3 amino acid sequence (NP_001158089.1) |
| 3 | Signal sequence |
| 4 | T cell receptor α-chain peptide (CAA26636.1) |

TABLE 18-continued

| SEQ ID NO: | Name |
| --- | --- |
| 5 | T cell receptor β-chain peptide (C25777) |
| 6 | T cell receptor γ1-chain peptide (A26659) |
| 7 | T cell receptor γ2-chain peptide (AAB63312.1) |
| 8 | T cell receptor δ-chain peptide (AAA61033.1) |
| 9 | CD3 γ-chain nucleotide (NM_000073.2) |
| 10 | CD3 δ-chain nucleotide (NM_000732.4) |
| 11 | CD3 ε-chain nucleotide (NM_000733.3) |
| 12 | CD3 γ-chain peptide (NP_000064.1) |
| 13 | CD3 δ-chain peptide (NP_000723.1) |
| 14 | CD3 ε-chain peptide (NP_000724.1) |
| 15~22 | Peptide linker |
| 23 | Human Cγ1 |
| 24 | Human Cγ2 |
| 25 | Human Cγ3 |
| 26 | Human Cγ4 |
| 27 | FcγRI nucleotide (NM_000566.3) |
| 28 | FcγRI peptide (NP_000557.1) |
| 29 | FcγRIIA nucleotide (BC020823.1) |
| 30 | FcγRIIA peptide (AAH20823.1) |
| 31 | FcγRIIB nucleotide (BC146678.1) |
| 32 | FcγRIIB peptide (AAI46679.1) |
| 33 | FcγRIIIA nucleotide (BC033678.1) |
| 34 | FcγRIIIA peptide (AAH33678.1) |
| 35 | FcγRIIIB nucleotide (BC128562.1) |
| 36 | FcγRIIIB peptide (AAI28563.1) |
| 37 | Fc region (addition of A to the N terminus of RefSeq accession number AAC82527.1) |
| 38 | Fc region (addition of A to the N terminus of RefSeq accession number AAB59393.1) |
| 39 | Fc region (addition of A to the N terminus of RefSeq accession number AAB59394.1) |
| 40 | H0000, GPC3 H-chain variable region |
| 41 | GL4, GPC3 L-chain variable region |
| 42 | rCE115H, CE115 H-chain variable region |
| 43 | rCE115L, CE115 L-chain variable region |
| 44 | G1dh |
| 45 | ERY22_Hk |
| 46 | ERY22_Hh |
| 47 | GL4-ERY22_Hk |
| 48 | H0000-ERY22_L |
| 49 | rCE115H-ERY22_Hh |
| 50 | rCE115L-k0 |
| 51 | hCE115HL (Heavy chain of humanized CE115) |
| 52 | hCE115HA (Heavy chain of humanized CE115) |
| 53 | L0000 (Light chain of humanized CE115) |
| 54 | H0000-ERY27_HK |
| 55 | hCE115HA-ERY27_HE |
| 56 | L0000-k0 |
| 57 | E22Hh |
| 58 | E22Hk |
| 59 | Hi-Kn010G3 |
| 60 | E2702GsKsc |
| 61 | E2704sEpsc |
| 62 | E2702sKsc |
| 63 | k0 |
| 64 | CE115HA177 |
| 65 | CE115HA178 |
| 66 | CE115HA179 |
| 67 | CE115HA180 |
| 68 | hCE115HAa |
| 69 | TR01H006 |
| 70 | TR01H007 |
| 71 | TR01H008 |
| 72 | TR01H009 |
| 73 | TR01H010 |
| 74 | TR01H011 |
| 75 | TR01H012 |
| 76 | TR01H013 |
| 77 | TR01H014 |
| 78 | TR01H015 |
| 79 | TR01H016 |
| 80 | TR01H017 |
| 81 | TR01H018 |
| 82 | TR01H019 |
| 83 | TR01H020 |
| 84 | TR01H021 |
| 85 | TR01H022 |
| 86 | TR01H023 |
| 87 | TR01H024 |
| 88 | TR01H025 |
| 89 | TR01H026 |
| 90 | TR01H027 |
| 91 | TR01H028 |
| 92 | TR01H029 |
| 93 | TR01H030 |
| 94 | TR01H031 |
| 95 | TR01H032 |
| 96 | TR01H033 |
| 97 | TR01H034 |
| 98 | TR01H035 |
| 99 | TR01H036 |
| 100 | TR01H037 |
| 101 | TR01H038 |
| 102 | TR01H039 |
| 103 | TR01H040 |
| 104 | TR01H041 |
| 105 | TR01H042 |
| 106 | TR01H043 |
| 107 | TR01H044 |
| 108 | TR01H045 |
| 109 | TR01H046 |
| 110 | TR01H047 |
| 111 | TR01H048 |
| 112 | TR01H049 |
| 113 | TR01H050 |
| 114 | TR01H051 |
| 115 | TR01H052 |
| 116 | TR01H053 |
| 117 | TR01H054 |
| 118 | TR01H055 |
| 119 | TR01H056 |
| 120 | TR01H057 |
| 121 | TR01H058 |
| 122 | TR01H061 |
| 123 | TR01H062 |
| 124 | TR01H063 |
| 125 | TR01H064 |
| 126 | TR01H065 |
| 127 | TR01H066 |
| 128 | TR01H067 |
| 129 | TR01H068 |
| 130 | TR01H069 |
| 131 | TR01H070 |
| 132 | TR01H071 |
| 133 | TR01H072 |
| 134 | TR01H073 |
| 135 | TR01H074 |
| 136 | TR01H075 |
| 137 | TR01H076 |
| 138 | TR01H077 |
| 139 | TR01H079 |
| 140 | TR01H080 |
| 141 | TR01H081 |
| 142 | TR01H082 |
| 143 | TR01H083 |
| 144 | TR01H084 |
| 145 | TR01H090 |
| 146 | TR01H091 |
| 147 | TR01H092 |
| 148 | TR01H093 |
| 149 | TR01H094 |
| 150 | TR01H095 |
| 151 | TR01H096 |
| 152 | TR01H097 |
| 153 | TR01H098 |
| 154 | TR01H099 |
| 155 | TR01H100 |
| 156 | TR01H101 |
| 157 | TR01H102 |
| 158 | TR01H103 |
| 159 | TR01H104 |
| 160 | TR01H105 |
| 161 | TR01H106 |
| 162 | TR01H107 |
| 163 | TR01H108 |
| 164 | TR01H109 |

TABLE 18-continued

| SEQ ID NO: | Name |
|---|---|
| 165 | TR01H110 |
| 166 | TR01H111 |
| 167 | TR01H112 |
| 168 | TR01H113 |
| 169 | TR01H114 |
| 170 | GCH003 |
| 171 | GCH005 |
| 172 | GCH006 |
| 173 | GCH007 |
| 174 | GCH008 |
| 175 | GCH010 |
| 176 | GCH012 |
| 177 | GCH013 |
| 178 | GCH014 |
| 179 | GCH015 |
| 180 | GCH016 |
| 181 | GCH019 |
| 182 | GCH022 |
| 183 | GCH023 |
| 184 | GCH025 |
| 185 | GCH026 |
| 186 | GCH027 |
| 187 | GCH029 |
| 188 | GCH032 |
| 189 | GCH034 |
| 190 | GCH035 |
| 191 | GCH039 |
| 192 | GCH040 |
| 193 | GCH042 |
| 194 | GCH043 |
| 195 | GCH045 |
| 196 | GCH053 |
| 197 | GCH054 |
| 198 | GCH055 |
| 199 | GCH056 |
| 200 | GCH057 |
| 201 | GCH059 |
| 202 | GCH060 |
| 203 | GCH061 |
| 204 | GCH062 |
| 205 | GCH064 |
| 206 | GCH065 |
| 207 | GCH066 |
| 208 | GCH067 |
| 209 | GCH068 |
| 210 | GCH073 |
| 211 | GCH094 |
| 212 | GCH098 |
| 213 | GCH099 |
| 214 | GCH100 |
| 215 | H0610 |
| 216 | L0000vk1 |
| 217 | L0002 |
| 218 | L0003 |
| 219 | L0006 |
| 220 | L0007 |
| 221 | L0008 |
| 222 | L0009 |
| 223 | L0011 |
| 224 | L0012 |
| 225 | L0013 |
| 226 | L0014 |
| 227 | L0015 |
| 228 | L0016 |
| 229 | L0032 |
| 230 | L0038 |
| 231 | L0039 |
| 232 | L0041 |
| 233 | L0042 |
| 234 | L0043 |
| 235 | L0044 |
| 236 | L0045 |
| 237 | L0046 |
| 238 | L0047 |
| 239 | L0062 |
| 240 | L0063 |
| 241 | L0064 |
| 242 | L0065 |
| 243 | L0066 |
| 244 | L0069 |
| 245 | L0075 |
| 246 | L0079 |
| 247 | L0082 |
| 248 | L0085 |
| 249 | L0089 |
| 250 | L0090 |
| 251 | L0091 |
| 252 | L0093 |
| 253 | L0104 |
| 254 | L0106 |
| 255 | L0107 |
| 256 | L0109 |
| 257 | L0113 |
| 258 | L0115 |
| 259 | L0117 |
| 260 | L0120 |
| 261 | L0122 |
| 262 | L0123 |
| 263 | L0124 |
| 264 | L0125 |
| 265 | L0126 |
| 266 | L0127 |
| 267 | L0129 |
| 268 | L0132 |
| 269 | L0134 |
| 270 | L0136 |
| 271 | L0137 |
| 272 | L0138 |
| 273 | L0139 |
| 274 | L0140 |
| 275 | L0141 |
| 276 | L0143 |
| 277 | L0144 |
| 278 | L0145 |
| 279 | L0147 |
| 280 | L0148 |
| 281 | L0149 |
| 282 | L0151 |
| 283 | L0152 |
| 284 | L0154 |
| 285 | L0155 |
| 286 | L0157 |
| 287 | L0160 |
| 288 | L0161 |
| 289 | L0163 |
| 290 | L0167 |
| 291 | L0168 |
| 292 | L0173 |
| 293 | L0175 |
| 294 | L0180 |
| 295 | L0181 |
| 296 | L0186 |
| 297 | L0187 |
| 298 | L0200 |
| 299 | L0201 |
| 300 | L0202 |
| 301 | L0203 |
| 302 | L0204 |
| 303 | L0205 |
| 304 | L0206 |
| 305 | L0207 |
| 306 | L0208 |
| 307 | L0209 |
| 308 | L0210 |
| 309 | L0211 |
| 310 | L0212 |
| 311 | L0213 |
| 312 | L0214 |
| 313 | L0215 |
| 314 | L0216 |
| 315 | L0217 |
| 316 | L0218 |
| 317 | L0219 |
| 318 | L0220 |
| 319 | L0222 |
| 320 | L0223 |

TABLE 18-continued

| SEQ ID NO: | Name |
|---|---|
| 321 | L0224 |
| 322 | L0226 |
| 323 | L0227 |
| 324 | L0228 |
| 325 | L0229 |
| 326 | L0230 |
| 327 | L0231 |
| 328 | L0232 |
| 329 | L0233 |
| 330 | L0234 |
| 331 | L0235 |
| 332 | L0236 |
| 333 | L0237 |
| 334 | L0238 |
| 335 | L0239 |
| 336 | L0240 |
| 337 | L0241 |
| 338 | L0242 |
| 339 | L0243 |
| 340 | L0246 |
| 341 | L0247 |
| 342 | L0248 |
| 343 | L0249 |
| 344 | L0250 |
| 345 | L0258 |
| 346 | L0259 |
| 347 | L0260 |
| 348 | L0261 |
| 349 | L0262 |
| 350 | L0263 |
| 351 | L0264 |
| 352 | L0265 |
| 353 | L0266 |
| 354 | L0267 |
| 355 | L0268 |
| 356 | L0269 |
| 357 | L0270 |
| 358 | L0271 |
| 359 | L0272 |
| 360 | TR01L001 |
| 361 | TR01L002 |
| 362 | TR01L003 |
| 363 | TR01L004 |
| 364 | TR01L005 |
| 365 | TR01L006 |
| 366 | TR01L007 |
| 367 | TR01L008 |
| 368 | TR01L009 |
| 369 | TR01L010 |
| 370 | TR01L011 |
| 371 | TR01L012 |
| 372 | TR01L013 |
| 373 | TR01L015 |
| 374 | TR01L016 |
| 375 | TR01L017 |
| 376 | TR01L018 |
| 377 | TR01L019 |
| 378 | TR01L020 |
| 379 | TR01L023 |
| 380 | TR01L024 |
| 381 | CE115HA122-E22Hh |
| 382 | CE115HA236-E22Hh |
| 383 | CE115HA251-E22Hh |
| 384 | GCH054-E2704sEpsc |
| 385 | GCH065-E2704sEpsc |
| 386 | GCH094-E2704sEpsc |
| 387 | H0610-E2704sEpsc |
| 388 | hCE115HA-E22Hh |
| 389 | rCE115H-E22Hh |
| 390 | rCE115H-E2702GsKsc |
| 391 | TR01H002-E22Hh |
| 392 | TR01H015-E22Hh |
| 393 | TR01H040-E2702GsKsc |
| 394 | TR01H061-E2702GsKsc |
| 395 | TR01H067-E2702GsKsc |
| 396 | TR01H068-E2702GsKsc |
| 397 | TR01H071-E2702GsKsc |
| 398 | TR01H082-E2702GsKsc |
| 399 | TR01H084-E2702GsKsc |
| 400 | TR01H109-E2702GsKsc |
| 401 | TR01H113-E2702GsKsc |
| 402 | TR01H113-E2702sKsc |
| 403 | GL4-E22Hk |
| 404 | L0000-E22Hk |
| 405 | H0000-E22L |
| 406 | H0610-E22L |
| 407 | rCE115L-k0 |
| 408 | GLS3108-k0 |
| 409 | L0000-k0 |
| 410 | L0011-k0 |
| 411 | L0201-k0 |
| 412 | L0203-k0 |
| 413 | L0204-k0 |
| 414 | L0206-k0 |
| 415 | L0208-k0 |
| 416 | L0209-k0 |
| 417 | L0211-k0 |
| 418 | L0212-k0 |
| 419 | L0222-k0 |
| 420 | TR01H001 |
| 421 | TR01H002 |
| 422 | TR01H003 |
| 423 | TR01H004 |
| 424 | rCE115H |
| 425 | CE115HA121 |
| 426 | CE115HA122 |
| 427 | CE115HA124 |
| 428 | CE115HA192 |
| 429 | CE115HA236 |
| 430 | CE115HA251 |
| 431 | CE115HA252 |
| 432 | E22L |

Figure 26A:
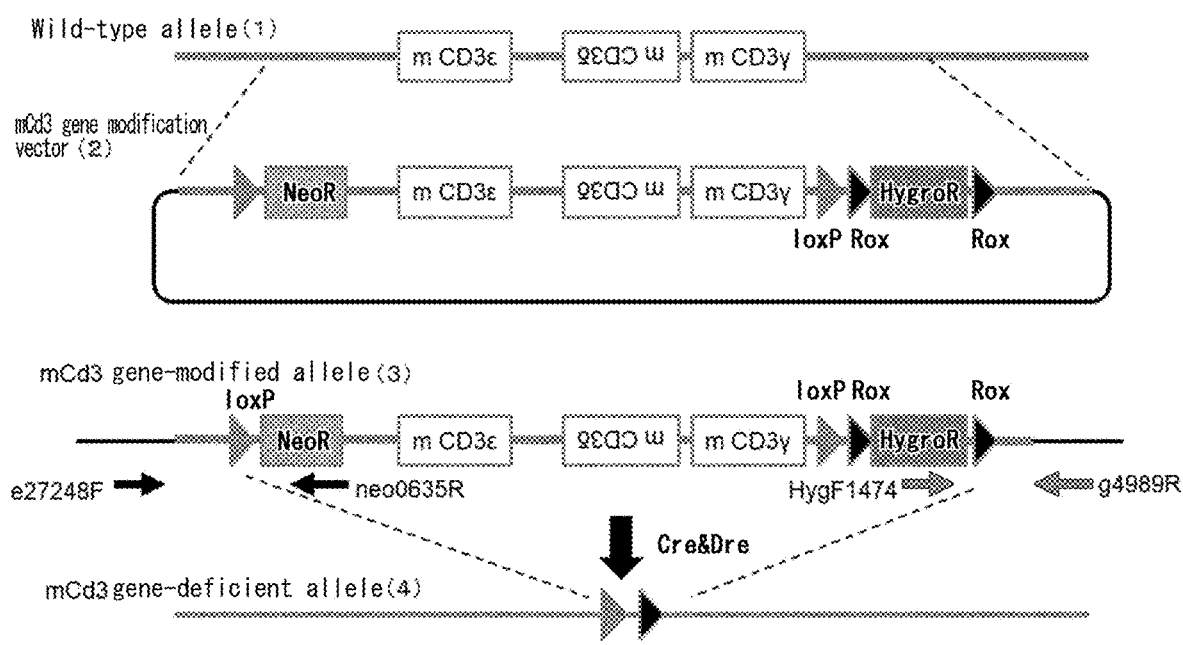
FIG. 26A presents the structure of a genomic DNA containing mouse Cd3ε, Cd3δ, and Cd3γ genes (1), a mouse Cd3 gene modification vector constructed by modifying a bacterial artificial chromosome (BAC) clone containing the whole gene region (2), the structure of a genomic DNA in which loxP and Rox sequences have been inserted at the target position using the above-mentioned vector (3), and the structure of a Cd3ε, Cd3δ, and Cd3γ-gene deficient allele produced by the actions of Cre and Dre recombinases (4).

[Reference Example 10] Production of Human CD3 Gene-Substituted Mice (1) Construction of a Mouse Cd3 Gene Region Modification Vector (FIG. 26A)

A bacterial artificial chromosome (BAC) clone was used, into which a genomic region where the mouse CD3ε, CD3δ, and CD3γ genes are positioned had been cloned. A loxP sequence was inserted at the position approximately 3.5 kb 5' upstream of the gene region encoding mouse Cd3ε in this BAC, and the genome region further upstream was removed leaving approximately 3.1 kb. At that time, the loxP sequence was introduced together with neomycin-resistance (neo) gene cassette and insertion was conducted by homologous recombination using a Red/ET system (GeneBridges). In that case, from among the *Escherichia coli* clones that grew in a kanamycin-supplemented medium, clones for which polymerase chain reaction (PCR) method resulted in correct amplification were selected. Next, loxP sequence and Rox sequences were placed at 3' downstream of the Cd3γ gene on the BAC. More specifically, the loxP sequence and Rox sequences were introduced along with hygromycin-resistance (Hyg) gene cassette, and insertion was conducted by homologous recombination using a Red/ET system. In that case, from among the *Escherichia coli* clones that grew in a hygromycin-supplemented medium, clones in which the loxP sequence and Rox sequences were inserted as expected were selected by PCR method. Next, the genomic region 3' downstream of the Hyg gene cassette was removed leaving approximately 3.4 kb.

(2) Introduction of a Mouse Cd3 Gene Region Modification Vector into Mouse Embryonic Stem Cells (ES Cells) (FIG. 26A)

The above-mentioned mouse Cd3 gene region modification vector was introduced into mouse ES cells (C57BL/6N mouse-derived cells) via electroporation, and after selective culturing with G418, drug-resistant clones were obtained. From these clones, screening for homologous recombinants was performed by a PCR method. For electroporation, 60 µg of the mouse Cd3 gene region modification vector was linearized with NotI or the NotI-untreated circular vector was extracted with phenol/chloroform, precipitated with ethanol, and then dissolved in PBS.

ES cells used in screening were cultured on a 96-well plate and washed twice using 200 µl of PBS solution per well. Then, the cells were treated at 55° C. for two hours after adding a cell lysis buffer having the following composition (5 µl of 10×LA buffer II (TAKARA LA for Taq), 5 µl of 25 mM MgCl$_2$, 5 µl of 5% NP-40, 2 µl of proteinase K (TAKARA, 20 mg/ml), and 33 µl of distilled water), and subsequently treated at 95° C. for 15 minutes to inactivate proteinase K, to thereby serve as PCR samples.

The PCR reaction mixture was made up of 1 µl of the sample, 2.5 µl of 10×LA buffer II, 2.5 µl of 25 mM MgCl$_2$, 4 µl of dNTP (2.5 mM), 0.1 µl each of the primers (50 µM each), 0.25 µl of LA Taq (TAKARA), and 14.55 µl of distilled water (25 µl in total). The PCR conditions included preheating at 94° C. for two minutes, 35 cycles of an amplification cycle of 98° C. for ten seconds and 68° C. for 4 minutes 30 seconds, and additional heating at 68° C. for five minutes.

Figure 27:
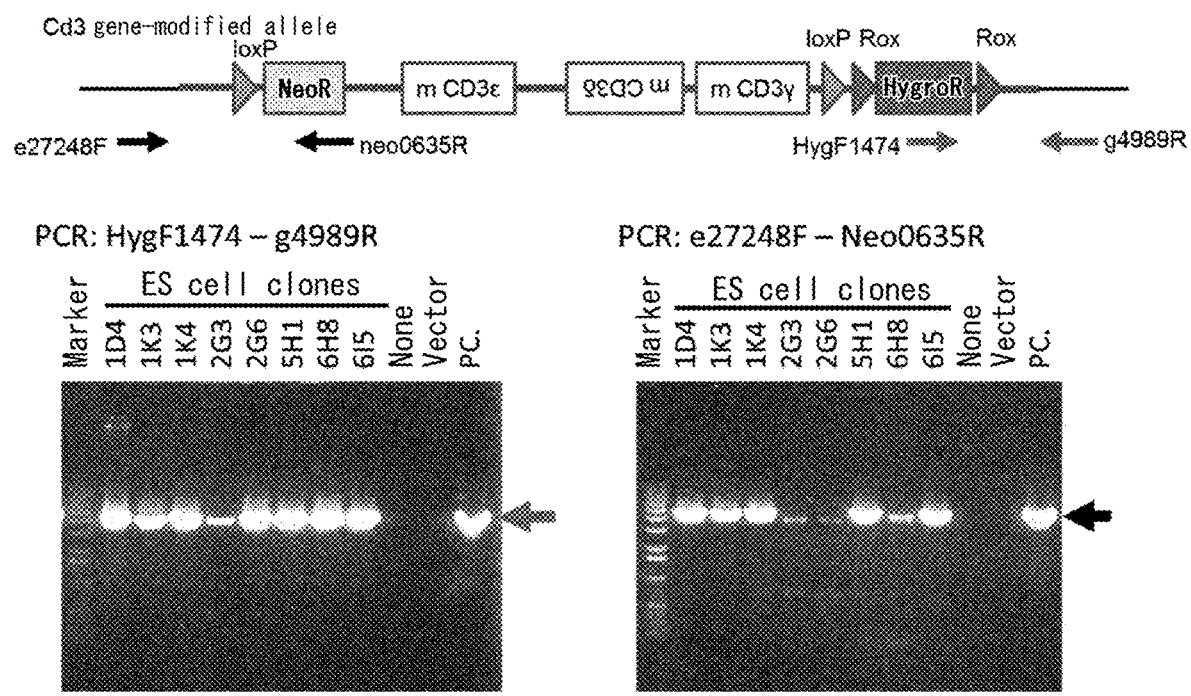
FIG. 27 presents the representative examples of PCR analyses performed for establishing mouse Cd3 gene-modified ES cells.

The following primers were used. The primers were HygF1474 which was positioned within the Hyg gene cassette as a forward primer, and g4989R which was positioned as a reverse primer at the mouse genomic region on the 3' downstream side of the 3' homology arm in the mouse Cd3 gene modification vector (see FIG. 27). In samples of the ES cells in which homologous recombination occurred, an approximately 4-kb band was amplified. HygF1474 (forward) 5'-TATCAGAGCTTGGTTGACGG-3' (SEQ ID NO: 436); and g4989R (reverse) 5'-ACTCGTTGTGGCT-TAGAAGCAGTAACAATACC-3' (SEQ ID NO: 437). Furthermore, clones from which amplification signals were obtained using the above-mentioned primer set were subjected to validation using a different primer set. More specifically, e27248F was positioned as a forward primer at the mouse genomic region on the 5' upstream side of the 5' homology arm in the mouse Cd3 gene modification vector, and Neo0635R was positioned as a reverse primer within the Neo gene cassette. In samples of ES cells in which homologous recombination occurred, an approximately 4-kb band was amplified. e27248F (forward) 5'-ACTGTAATCCTAGTACTTAGGAGGCTGAGG-3' (SEQ ID NO: 438); and Neo0635R (reverse) 5'-AATC-CATCTTGTTCAATGGCCGATCC-3' (SEQ ID NO: 439).

Figure 26B:
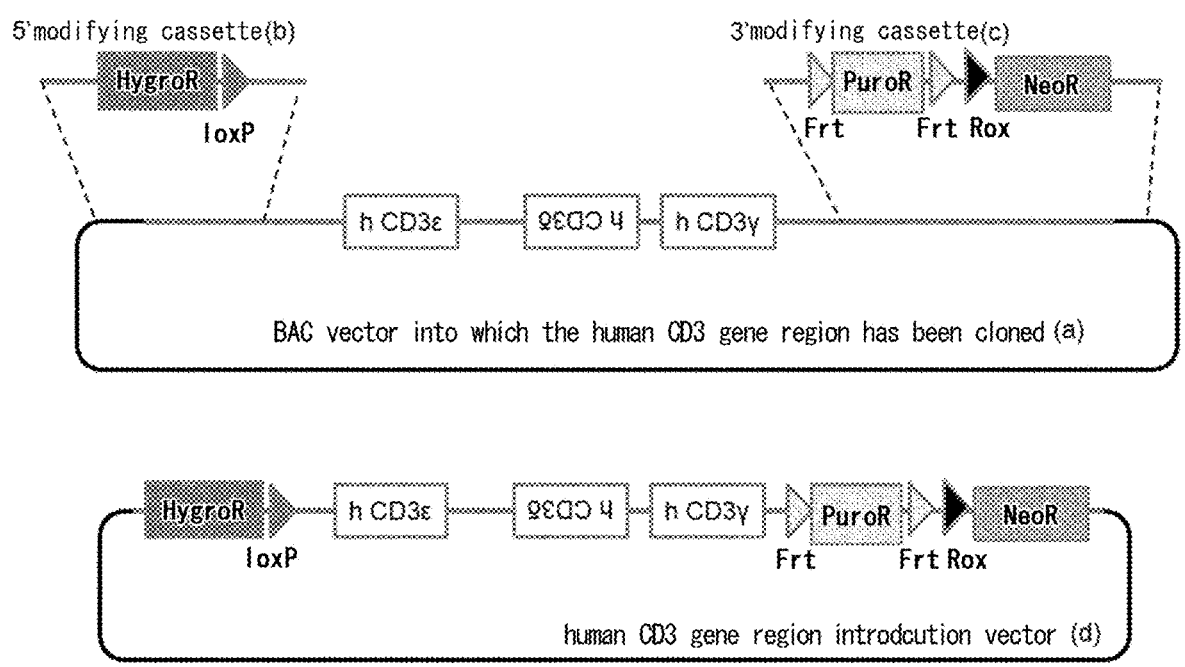
FIG. 26B presents the structures of a BAC clone containing human CD3ε, CD3δ, and CD3γ genes (a); 5'-modifying cassette (b) and 3'-modifying cassette (c), both of which are for modifying the BAC clone; and a human CD3 gene region introduction vector constructed through modifications using those above (d).

(3) Construction of a Human CD3 Gene Region Introduction Vector (FIG. 26B)

A BAC clone was used, into which a genomic region where the human CD3ε, CD3δ, and CD3γ genes are positioned had been cloned. A loxP sequence was inserted at 5' upstream of the gene region encoding human CD3ε in this BAC. At that time, the loxP sequence was introduced along with Hyg gene cassette, and insertion was conducted by homologous recombination using a Red/ET system (GeneBridges). In that case, from among the *Escherichia coli* clones that grew in a hygromycin-supplemented medium, clones for which PCR method resulted in correct amplification were selected. Next, at 3' downstream of the human CD3γ gene in the BAC, puromycin-resistance (Puro) gene flanked on both ends by Frt sequences was introduced together with Neo gene cassette to position a Rox sequence further downstream, and insertion was conducted by homologous recombination using a Red/ET system. In that case, from among the *Escherichia coli* clones that grew in a kanamycin-supplemented medium, clones in which the Frt sequences, the Puro gene, the Rox sequence, and the Neo gene were inserted as expected were selected by PCR method.

(4) Introduction of a Human CD3 Gene Region Introduction Vector and a Recombinase Expression Vector into Cd3 Gene Region-Modified Mouse ES Cells The human CD3 gene region introduction vector, a Cre recombinase expression vector, and a Dre recombinase expression vector were introduced via electroporation into ES cell clones (1D4, SH1, 615, and 3A5) in which the loxP sequences and Rox sequences were correctly inserted at the targeted sites of the mouse Cd3 gene region in the above-mentioned step; and after selective culturing with puromycin, the grown ES cell clones were genotyped.

First, PCR screening was performed for selection of clones in which recombination between the loxP sequences and between the Rox sequences placed at the mouse Cd3 gene region took place by the action of Cre and Dre, and the genomic region from Cd3ε to Cd3γ was deleted. The ES cells used in screening were cultured on a 96-well plate, washed twice using 200 µl of PBS per well, and treated at 55° C. for two hours after adding a cell lysis buffer having the following composition (5 µl of 10×LA buffer II (TAKARA LA for Taq), 5 µl of 25 mM MgC$_2$, 5 µl of 5% NP-40, 2 µl of proteinase K (TAKARA, 20 mg/mL), and 33 µl of distilled water), and subsequently treated at 95° C. for 15 minutes to inactivate proteinase K, to thereby serve as PCR samples.

Figure 28A:
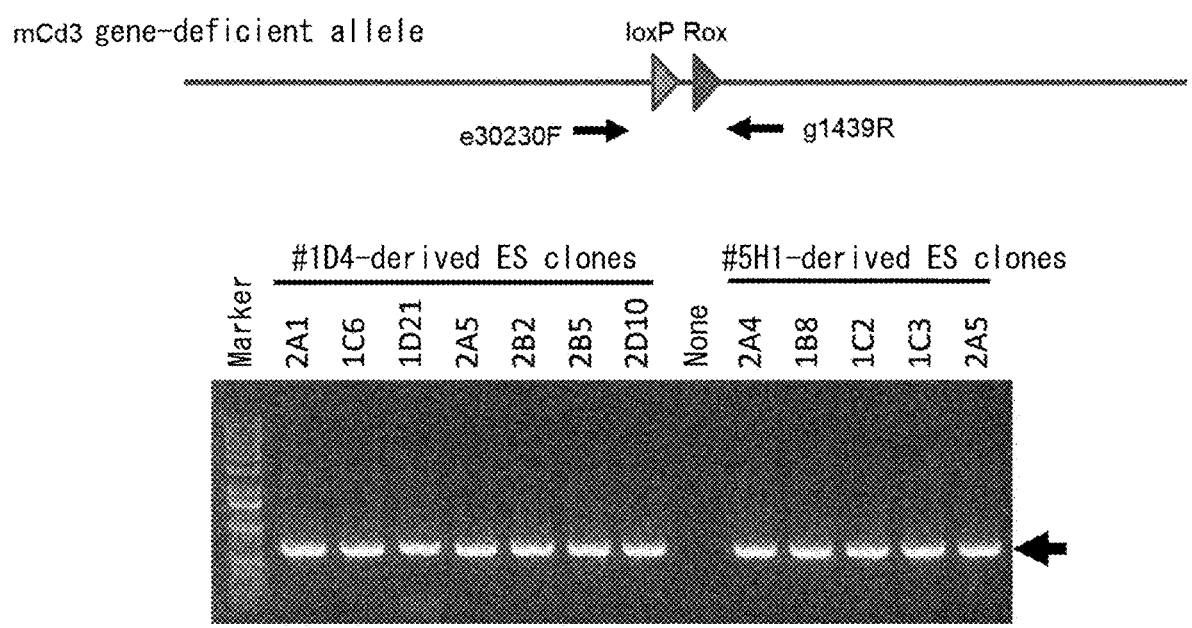
FIG. 28A presents the representative examples of PCR results that detect the deficiency of the mouse Cd3 gene region.

The PCR reaction mixture was made up of 1 µl of the sample, 2.5 µl of 10×LA buffer II, 2.5 µl of 25 mM MgCl$_2$, 4 µl of dNTP (2.5 mM), 0.1 µl each of the primers (50 µM each), 0.25 µl of LA Taq (TAKARA), and 14.55 µl of distilled water (25 µl in total). The PCR conditions included preheating at 94° C. for two minutes, 35 cycles of an amplification cycle of 98° C. for ten seconds and 68° C. for 4 minutes 30 seconds, and additional heating at 68° C. for five minutes. The following primers were used. The primers were e30230F which was positioned as a forward primer at the genomic region on the 5' upstream side of the mouse Cd3ε gene, and g1439R which was positioned as a reverse primer at the genomic region on the 3' downstream side of the mouse Cd3γ gene (see FIG. 28A). In samples of the ES cells in which the Cd3 gene region was deleted, an approximately 0.7-kb band was amplified. e30230F (forward) 5'-TAGCAGCCTTCAGATGAAGAGGTAGGACTC-3' (SEQ ID NO: 440); and g1439R (reverse) 5'-TTGATGTGC-CACCTCACTGCTGCACTGG-3' (SEQ ID NO: 441).

Figure 28B:
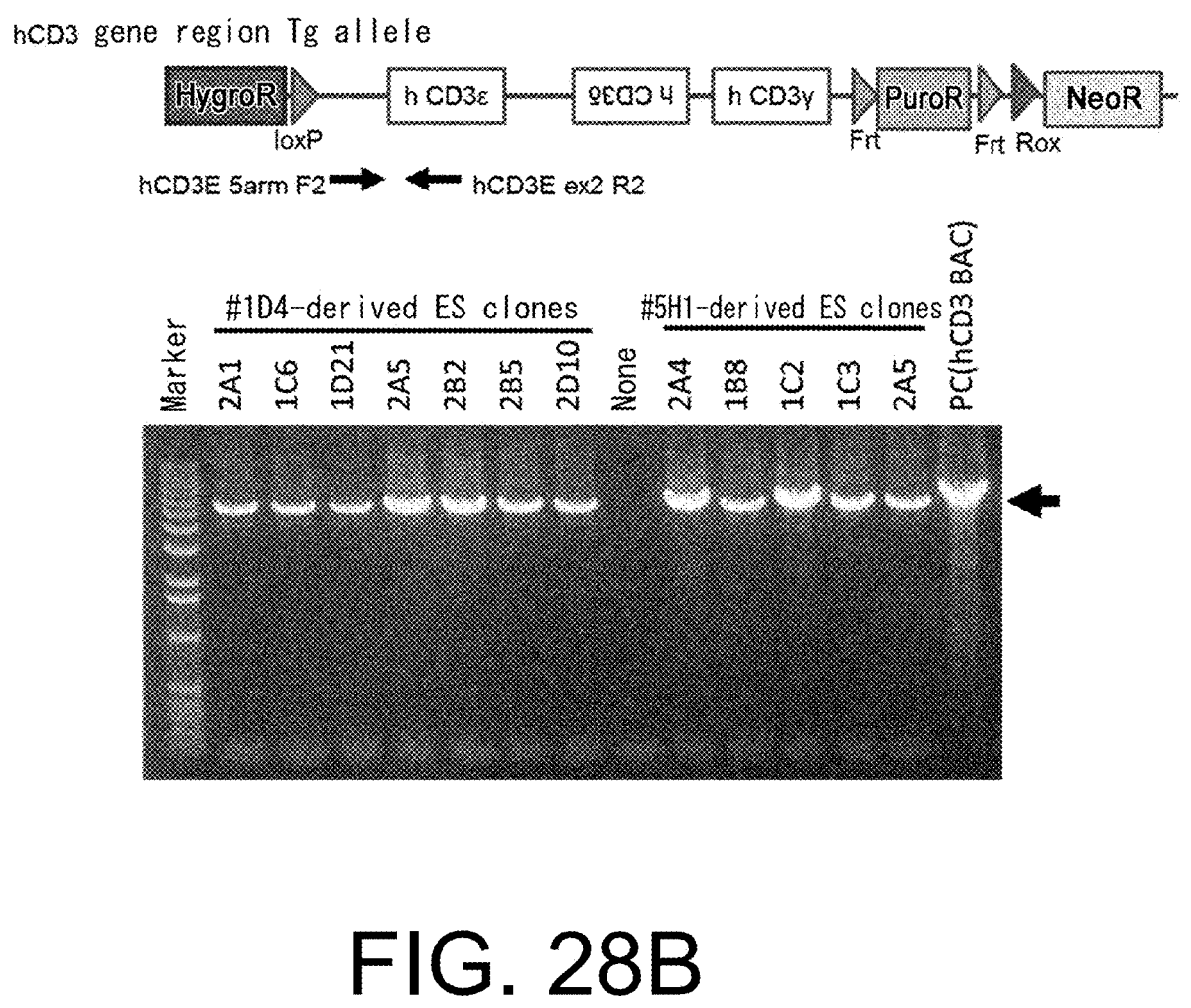

PCR screening was performed for selecting clones in which the human CD3 gene region was introduced from the ES cell clones deficient in the mouse Cd3 gene region. The PCR samples that were used for detecting the deletion of the mouse Cd3 gene region were subjected to the screening. The PCR reaction mixture was made up of 1 µl of the sample, 2.5 µl of 10×LA buffer II, 2.5 µl of 25 mM MgCl$_2$, 4 µl of dNTP (2.5 mM), 0.1 µl each of the primers (50 µM each), 0.25 µl of LA Taq (TAKARA), and 14.55 µl of distilled water (25 µL in total). The PCR conditions included preheating at 94° C. for two minutes, 35 cycles of an amplification cycle of 94° C. for 30 seconds, 58° C. for one minute, and 72° C. for five minutes, and additional heating at 72° C. for five minutes. The following primers were used. The primers were hCD3e_5arm_F2 which was positioned as a forward primer at the genomic region on the 5' upstream side of the human CD3ε gene, and hCD3e_ex2_R2 which was positioned as a reverse primer within the second exon of the human CD3ε gene (see FIG. 28B). In samples of the ES cells in which the human CD3 gene region was introduced, an approximately 5.5-kb band was amplified. hCD3e_5arm_F2 (forward) 5'-AACTGACAATGGGACATCAGCTGA-3' (SEQ ID NO: 442); and hCD3e_ex2_R2 (reverse) 5'-ATGGGACTGTTACTTTACTAAGAT-3' (SEQ ID NO: 443).

(5) Production of Mouse Cd3 Gene-Deficient and Human CD3 Gene-Introduced Mice

The homologous recombinant ES clones were suspended by trypsin treatment, and washed with the ES cell medium. Female BALB/c mice which were subjected to superovulation treatment by administering 5 IU of equine chorionic gonadotropin (eCG) and human chorionic gonadotropin (hCG) intraperitoneally at 48-hour intervals were crossed with male mice of the same strain. The day when a plug was confirmed in a female mouse was regarded as day 0.5. On gestation day 3.5, blastocyst-stage embryos collected by perfusing the uterus were used as host embryos, in which 10 to 15 of the ES cells were injected. The embryos after the injection were transferred into the uterus of ICR recipient females on Day 2.5 pseudopregnancy, and their offspring were obtained 17 days later. Screening based on the coat color of the offspring obtained by injection of the ES cells to the blastocysts, yielded chimeric mice having a mixture of the recombinant ES cells (black) and the host blastocyst-derived cells (albino). After sexual maturation, the male chimeric mice were crossed with C57BL/6N-female mice, and transmission of the knock-in allele to the next generation was confirmed by a PCR method using the genomic DNA extracted from the tissues of the second-generation mice as the template. PCR was performed by the above-mentioned method used for screening of the ES cells. As a result, individuals from which the human CD3 gene region-specific 5.5-kb signal and the mouse Cd3 gene region deficiency-specific 0.7-kb signal were detected were obtained, and the human CD3 gene region allele and the mouse Cd3 gene region-deficient allele were confirmed to be transmitted to these individuals. Furthermore, breeding of mice having the above-described genotype yielded mouse individuals whose mouse Cd3 gene region is homozygously deleted and which have the human CD3 gene region, that is, human CD3 gene region-substituted mice were obtained. Transgenic mice in which human CD3ε alone had been introduced (hereinafter, hCD3εTg mice) were produced according to the report by Wang et al. (Wang et. al. (1994) PNAS. 91:9402-9406), and they were examined as comparisons in the later experiments.

(6) Thymus Weights and Spleen Weights of Human CD3 Gene-Substituted Mice

Figure 29:
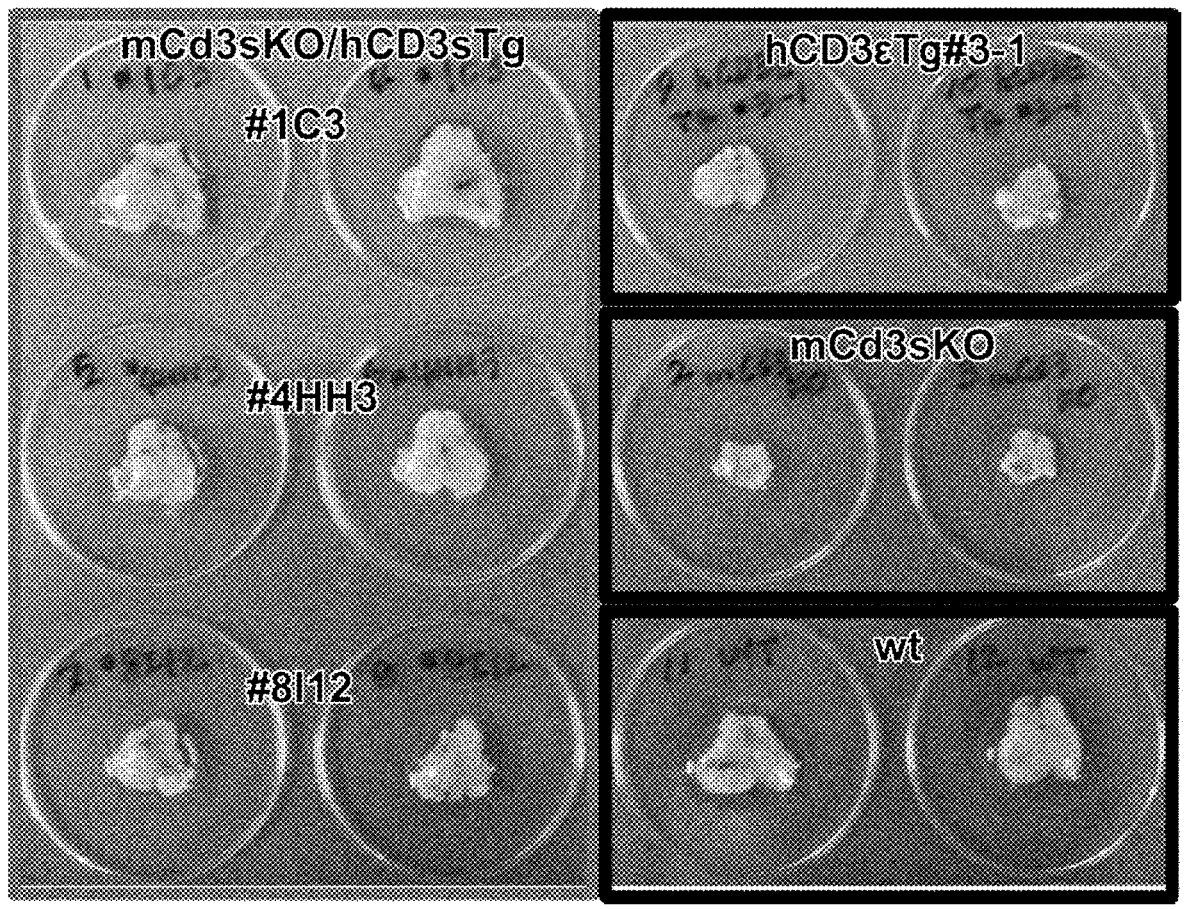
FIG. 29 presents the representative macroscopic photographs of thymuses collected from each of the established lines of human CD3 gene-substituted mice, Cd3 gene-deficient mice, wild type, and human CD3ε gene-introduced mice. Thymuses extirpated from 12 to 13-week-old males are shown for the respective genotypes.
Figure 30:
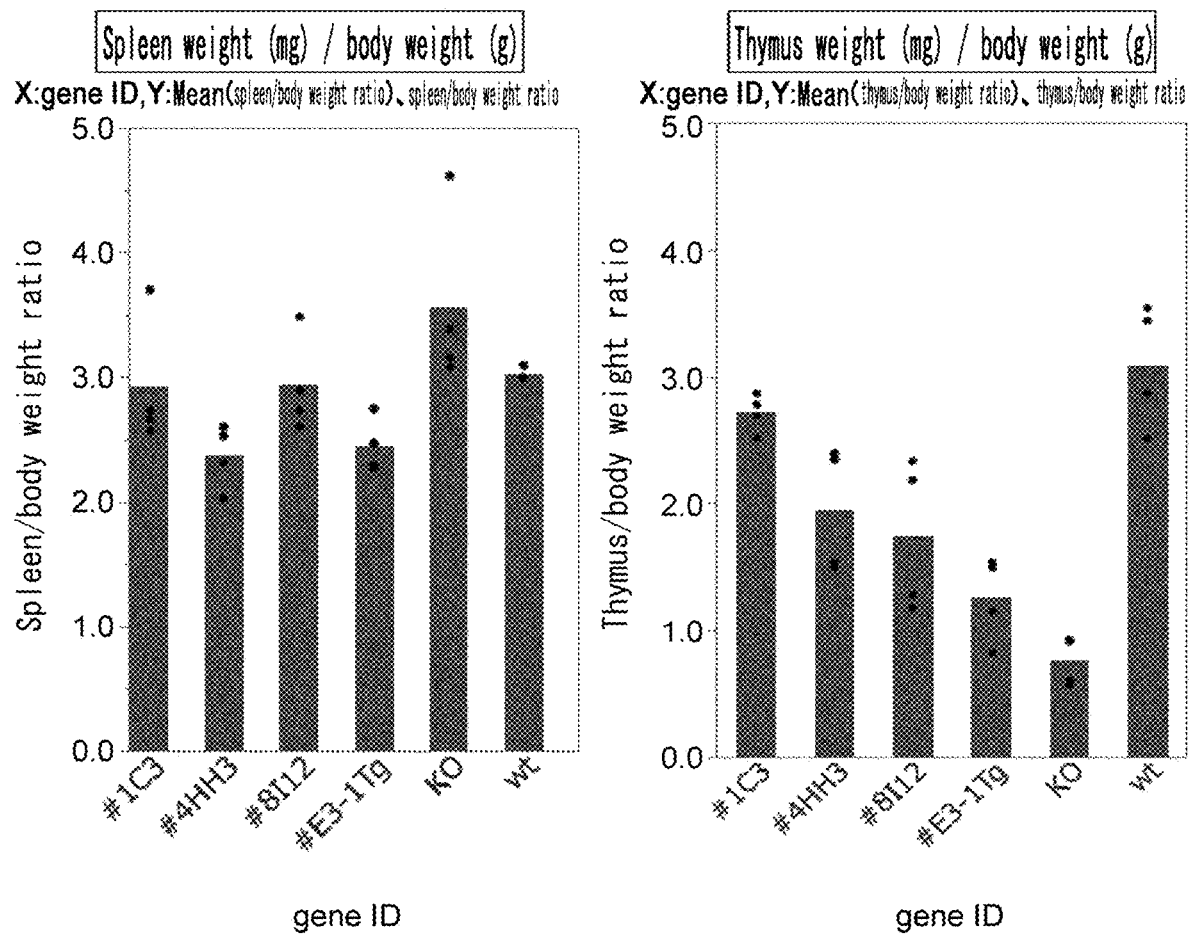
FIG. 30 presents the results of measuring the tissue weights of the spleens and thymuses collected from each of the established lines of human CD3 gene-substituted mice, Cd3 gene-deficient mice, wild-type, and human CD3ε gene-introduced mice. Ratios of tissue weight per body weight were calculated, and the value obtained for each individual is plotted by a black dot and the mean values are shown by columns.

Spleen and thymus were collected from mice (12 to 14-week old, male) and the tissue weights were measured. As shown in FIG. 29, the thymus of the human CD3-substituted mice did not show gross abnormalities. Tissue weight per body weight was calculated for analysis. The body weights and tissue weights (spleen and thymus) were measured for four male mice in each group, and represented as graphs. The tissue weight per body weight ratios were calculated, the values obtained for each individual are plotted by a black dot, and the mean value is shown by a column (FIG. 30). Regarding spleen weight, increasing trend was observed in the Cd3 gene-deficient mice as compared to mice of other genotypes, but no remarkable differences were observed. On the other hand, regarding thymus weight, the Cd3 gene-deficient mice showed decrease down to one third or so as compared to that of the wild-type. In the human CD3 gene-substituted mice produced by introducing a human CD3 gene into the Cd3 gene-deficient mice, recovery of thymus weight was observed, and particularly in the individuals of line no. 1C3, thymus weight was recovered even to the level equivalent to that of the wild-type mice. As reported by Wang et al., thymic atrophy was observed in hCD3εTg mice (Wang et. al. (1994) PNAS. 91:9402-9406).

(7) Confirmation of Expressions of Human CD3 and Mouse Cd3 in the Respective Lines of Human CD3 Gene-Substituted Mice —Confirmation by RT-PCR Method Using Hemocyte RNA—

Expressions of human CD3ε, human CD3δ, human CD3γ, mouse Cd3ε, mouse Cd3δ, and mouse Cd3γ were analyzed by RT-PCR using hemocyte RNA. Using a Catrimox-14 RNA Isolation Kit (TaKaRa Bio), total RNA was prepared from blood collected from the dorsal metatarsal vein or the abdominal vena cava. A 1 µg portion each of the total RNAs was used as a template to synthesize cDNAs by performing reverse transcription reactions with a SuperScript III First Strand cDNA Synthesis Kit (Invitrogen) using Oligo dT (20) primers. Human CD3ε, human CD3δ, human CD3γ, mouse Cd3ε, mouse Cd3δ, and mouse Cd3γ were detected by performing PCR using the synthesized cDNAs as templates. Primers for the protein coding regions were designed to detect the expression of all of the genes. Human CD3ε was detected using the combination of forward primer E0333F (5'-AAGAAATGGGTGGTATACACAGACACC-3' (SEQ ID NO: 444)) and reverse primer E0912R (5'-TGGGCCAGCGGGAGGCAGTGTCTCCAGAGG-3' (SEQ ID NO: 445)). Human CD3δ was detected using the combination of forward primer D0092F (5'-TAGTTCGGTGACCTGGCTTTATCTACTGG-3' (SEQ ID NO: 446)) and reverse primer D0685R (5'-ATGGCTGCTCTAGAAGCCACCAGTCTCAGG-3' (SEQ ID NO: 447)). Human CD3γ was detected using the combination of forward primer G0048F (5'-TGCTCCACGC-TITTGCCGGAGGACAG-3' (SEQ ID NO: 448)) and reverse primer G0666R (5'-TAGGAG-GAGAACACCTGGACTACTC-3' (SEQ ID NO: 449)). On the other hand, mouse Cd3ε was detected using the combination of forward primer e0065F (5'-AGCATTCTGAGAG-GATGCGGTGGAACAC-3' (SEQ ID NO: 450)) and reverse primer e0699R (5'-TGCTCGGAGGGCTG-GATCTGGGTCCACAG-3' (SEQ ID NO: 451)). Mouse Cd3δ was detected using the combination of forward primer d055F (5'-TCATCCTGTGGCTTGCCTCTATTTGTTGC-3' (SEQ ID NO: 452)) and reverse primer d651R (5'-TTGC-TATGGCACTTTGAGAAACCTCCATC-3' (SEQ ID NO: 453)). Mouse Cd3γ was detected using the combination of forward primer g080F (5'-AATACTCTACTG-GAGAAGCAAAGAG-3' (SEQ ID NO: 454)) and reverse primer g316R (5'-TAGTTGCATTTAGAGGACTTAT-TATGC-3' (SEQ ID NO: 455)).

The composition of the PCR reaction solution (25 µl in total) was made up of 1 µl of the sample, 2.5 µl of 10×Ex buffer, 2 µl of dNTP (2.5 mM), 0.1 µl each of the primers (50 µM each), 0.25 µl of Ex Taq (TAKARA), and 19.05 µl of distilled water. The PCR conditions for human CD3δ, human CD3γ, mouse Cd3δ, and mouse Cd3γ included preheating at 94° C. for two minutes, 35 cycles of an amplification cycle of 94° C. for 30 seconds, 60° C. for 30 seconds, and 72° C. for two minutes, and additional heating at 72° C. for five minutes. For human CD3ε and mouse Cd3ε, the PCR conditions included preheating at 94° C. for two minutes, 40 cycles of an amplification cycle of 94° C. for 30 seconds, 60° C. for 30 seconds, and 72° C. for two minutes, and additional heating at 72° C. for five minutes. PCR primers were designed so that the detected amplification products of human CD3ε, human CD3δ, and human CD3γ will be 580 bp, 594 bp, and 620 bp, respectively, and those of mouse Cd3ε, mouse Cd3δ, and mouse Cd3γ will be 635 bp, 597 bp, and 237 bp, respectively.

Figure 31:
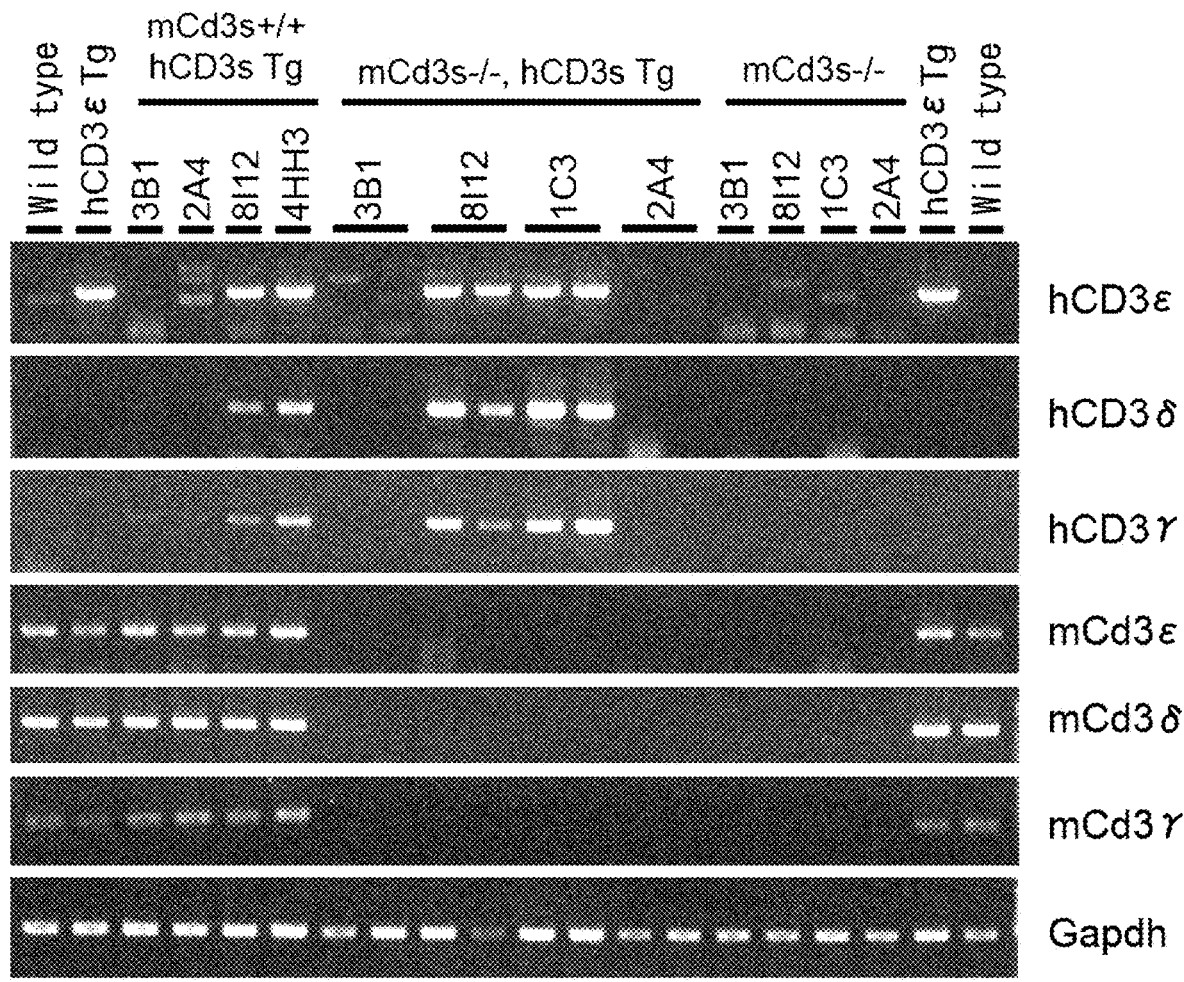
FIG. 31 presents the results of examining by RT-PCR the expressions of each of the human CD3 molecules and each of the mouse Cd3 genes in each of the established lines of human CD3 gene-substituted mice, Cd3 gene-deficient mice, wild-type mice, and human CD3ε gene-introduced (hCD3ε Tg) mice. Among the established lines of the human CD3 gene-substituted mice, signals specific to hCD3ε, hCD3δ, and hCD3γ were detected in line numbers 1C3 and 8I12. The signals were not detected in line numbers 3B1 and 2A4.
Figure 33:
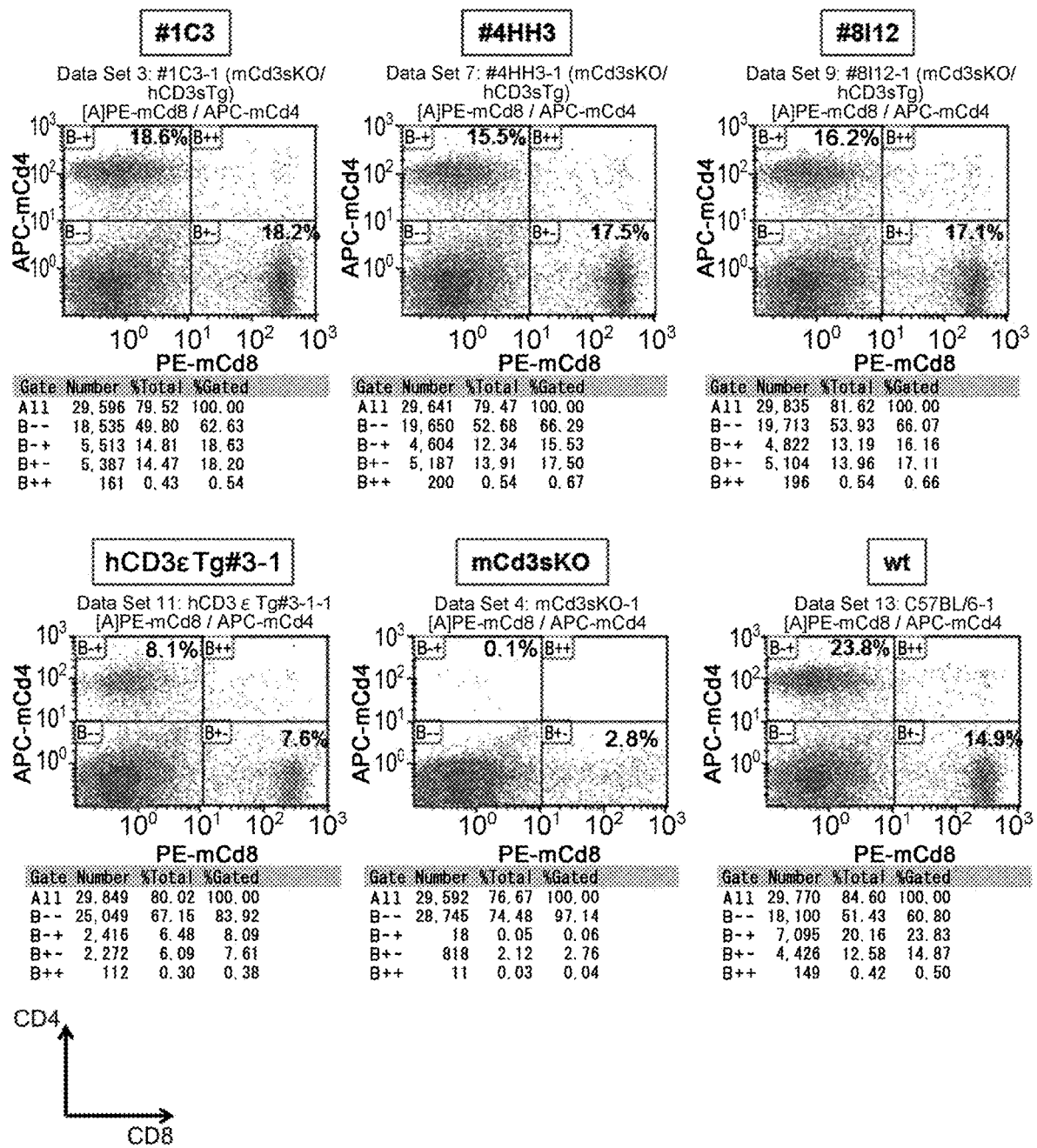
FIG. 33 presents the representative results of analyzing by FACS the abundance ratio of mature T cells in the thymus of each established line of human CD3-substituted mice.

In the Cd3 gene-deficient mice, the respective mouse Cd3 molecule-derived PCR signals were not detected. Only human CD3ε, human CD3δ, and human CD3γ were detected, and none of mouse Cd3ε, mouse Cd3δ, and mouse Cd3γ was detected from the samples derived from lines 1C3 and 8I12 of the above-mentioned lines among the human CD3 gene-substituted mouse lines (line nos. 1C3, 3B1, 8I12, and 2A4) produced by introducing the human CD3 gene region to the Cd3 gene-deficient mice (FIG. 31). From the samples derived from wild-type mice, human CD3ε, human CD3δ, and human CD3γ were not detected, and mouse Cd3ε, mouse Cd3δ, and mouse Cd3γ were detected (FIG. 31). These results confirmed that mice expressing human CD3ε, CD3δ, and CD3γ instead of mouse Cd3ε, Cd3δ, and Cd3γ were obtained as designed. Line 4HH3 in FIG. 31 was analyzed in an individual in which the mouse Cd3 allele is a wild-type and the human CD3 gene has been introduced, and the respective human CD3 molecules and the respective mouse Cd3 molecules are both detected. Subsequently, it was cross-bred with Cd3-deficient mice to establish a mouse Cd3 allele-deficient and human CD3 gene-expressing line.

—Analysis by Immunohistological Staining—

The tissue distribution was examined using the anti-CD3 antibody as the primary antibody. CD3 staining was not observed in any of the tissues from the Cd3-deficient mice, while CD3-specific staining equivalent to that of wild-type mice was observed for the human CD3-substituted mice produced by introducing the human CD3 genes to the Cd3-deficient mice. More specifically, specific staining was observed in the T cell zones in the thymus (FIG. 32A) and spleen (FIG. 32B). In all tissues, staining was observed only in the T cell zone, similarly to the wild-type mice. Furthermore, staining was not observed in the Cd3 gene-deficient mice, indicating that staining in the human CD3 gene-substituted mice was due to the expression of the introduced human CD3 genes. Furthermore, the detection of CD3s in the major organs was the same as in the wild-type, and ectopic staining was not observed (Table 19).

TABLE 19 hCD3, mCD3KOTG mouse
IACUC 14-074

| | mCD3ko, hCD3TG Line | | | | | | | | |
|---|---|---|---|---|---|---|---|---|---|
| | #4HH3 | | | #8I12 | | | #1C3 | | |
| | Animal No. | | | | | | | | |
| | 008-130 | 010-163 | 003-91 | 003-85 | 003-86 | 001-60 | 168 | 169 | 97 |
| | Gender | | | | | | | | |
| Organs | ♀ | ♀ | ♂ | ♂ | ♂ | ♂ | ♀ | ♀ | ♂ |
| Findings | Date of IHC Staining: A, 2014 Jun. 19; B, 2014 Jun. 25 | | | | | | | | |
| IHC Staining: CD3 | A | A | A | A | A | A | A | A | A |
| Thymus | | | | | | | | | |
| Atrophy | + | ± | − | − | ± | − | − | − | − |
| Lymphocyte, cortex | ++ | +++ | +++ | +++ | +++ | +++ | +++ | +++ | +++ |
| Lymphocyte, medulla | +++ | +++ | +++ | +++ | +++ | +++ | +++ | +++ | +++ |
| Other tissues | − | − | − | − | − | − | − | − | − |
| Mesentery | | | | | | | | | |
| Atrophy | + | + | ± | − | ± | − | − | + | + |
| Lymphocyte, paracortex | ++ | ++ | ++ | +++ | +++ | ++ | +++ | ++ | ++ |
| Lymphocyte, follicle | + | + | + | + | + | + | + | + | + |
| Lymphocyte, medulla | + | + | + | + | + | + | + | + | + |
| Other tissues | − | − | − | − | − | − | − | − | − |
| Ileum | | | | | | | | | |
| Atrophy of GALT | − | − | − | − | − | − | − | − | − |
| Lymphocyte, GALT | + | ± | ± | ± | ++ | + | + | ++ | + |
| Lymphocyte, lamina propria | ± | + | + | ± | + | + | + | + | + |
| Other tissues | − | − | − | − | − | − | − | − | − |
| Spleen | | | | | | | | | |
| Atrophy | ± | − | − | − | − | ± | − | − | − |
| Lymphocyte, PALS | +++ | +++ | +++ | +++ | +++ | +++ | +++ | +++ | +++ |
| Lymphocyte, follicle | + | + | + | + | + | + | + | + | + |
| Lymphocyte, red pulp | ++ | ++ | ++ | ++ | ++ | ++ | ++ | ++ | ++ |
| Other tissues | − | − | − | − | − | − | − | − | − |
| Liver | | | | | | | | | |
| Lymphocyte, sinusoid | + | + | + | + | + | + | + | + | + |
| Other tissues | − | − | − | − | − | − | − | − | − |

TABLE 19-continued hCD3, mCD3KOTG mouse IACUC 14-074

| | | | | | | | | | |
|---|---|---|---|---|---|---|---|---|---|
| Kidney | | | | | | | | | |
| Lymphocyte, interstitium | ± | − | ± | ± | ± | ± | ± | ± | ± |
| Other tissues | − | − | − | − | − | − | − | − | − |
| Adrenal gland | | | | | | | | | |
| Lymphocyte, interstitium | − | − | − | − | − | ± | ± | − | ± |
| Other tissues | − | − | − | − | − | − | − | − | − |
| Lung | | | | | | | | | |
| Lymphocyte, alveolar wall | ± | − | ± | ± | ± | ± | ± | ± | ± |
| Other tissues | − | − | − | − | − | − | − | − | − |
| Heart | | | | | | | | | |
| Lymphocyte, interstitium | − | − | ± | − | − | − | ± | ± | ± |
| Other tissues | − | − | − | − | − | − | − | − | − |
| Gastrocnemius muscle | − | − | − | − | − | − | − | − | − |

| | hCD3 ε TG | | mCD3KO | | | C57BL/6N | | |
|---|---|---|---|---|---|---|---|---|
| Line | #3-1-78 | #195 | None | | | None | | |
| Animal No. | 195 | 790 | 001-63 | 001-64 | 001-67 | B6-01 | B6-02 | B6-03 |
| Gender | Positive control | ♀ | ♀ | ♀ | ♂ | ♀ | ♀ | ♂ |
| Organs Findings | | | Date of IHC Staining: A, 2014 Jun. 19; B, 2014 Jun. 25 | | | | | |
| IHC Staining: CD3 | A | A | A | A | A | B | B | B |
| Thymus | | | | | | | | |
| Atrophy | + | − | ++ | ++ | ++ | − | − | − |
| Lymphocyte, cortex | +++ | +++ | − | − | − | +++ | +++ | +++ |
| Lymphocyte, medulla | +++ | +++ | − | − | − | +++ | +++ | +++ |
| Other tissues | − | − | − | − | − | − | − | − |
| Mesentery | NA | NA | | | | | | |
| Atrophy | | | ++ | ++ | ++ | − | − | − |
| Lymphocyte, paracortex | | | − | − | − | +++ | +++ | +++ |
| Lymphocyte, follicle | | | − | − | − | + | + | + |
| Lymphocyte, medulla | | | − | − | − | + | + | + |
| Other tissues | | | − | − | − | − | − | − |
| Ileum | NA | NA | | | | | | |
| Atrophy of GALT | | | ++ | ++ | ++ | − | − | − |
| Lymphocyte, GALT | | | − | − | − | ++ | + | + |
| Lymphocyte, lamina propria | | | − | − | − | + | + | ± |
| Other tissues | | | − | − | − | − | − | − |
| Spleen | | | | | | | | |
| Atrophy | − | − | + | + | + | − | − | − |
| Lymphocyte, PALS | +++ | +++ | − | − | − | +++ | +++ | +++ |
| Lymphocyte, follicle | + | + | − | − | − | + | + | + |
| Lymphocyte, red pulp | ++ | ++ | − | − | − | ++ | ++ | ++ |
| Other tissues | − | − | − | − | − | − | − | − |
| Liver | | | | | | | | |
| Lymphocyte, sinusoid | NA | NA | − | − | − | + | + | + |
| Other tissues | | | − | − | − | − | − | − |
| Kidney | NA | NA | | | | | | |
| Lymphocyte, interstitium | | | − | − | − | ± | ± | ± |
| Other tissues | | | − | − | − | − | − | − |
| Adrenal gland | NA | NA | | | | | | |
| Lymphocyte, interstitium | | | − | − | − | ± | ± | ± |
| Other tissues | | | − | − | − | − | − | − |
| Lung | NA | NA | | | | | | |
| Lymphocyte, alveolar wall | | | − | − | − | ± | ± | ± |
| Other tissues | | | − | − | − | − | − | − |
| Heart | NA | NA | | | | | | |
| Lymphocyte, interstitium | | | − | − | − | ± | ± | ± |
| Other tissues | | | − | − | − | − | − | − |
| Gastrocnemius muscle | NA | NA | − | − | − | − | − | − |

Findings: −, negative; ±, very slight; +, slight; ++, moderate; +++, severe
IHC Staining: −, negative; ±, rare; +, occasional; ++, frequent; +++, constant (8) Evaluation of Abundance Ratio of Mature T Cells in Human CD3 Gene-Substituted Mice FACS analyses were preformed using spleen cells. Spleens were collected from mice (12 to 14-week old, male), and cells were isolated using 70 μm mesh. Erythrocytes were lysed by adding a hemolytic agent (manufactured by SIGMA). After blocking using an Fc blocking solution, FITC-labeled anti-mouse Cd3 antibody, FITC-labeled anti-human CD3 antibody, APC-labeled anti-mouse Cd4 antibody, and PE-labeled anti-mouse Cd8 antibody were used on $2 \times 10^6$ cells, and the respective positive cell counts were analyzed by a flow cytometer. It was revealed that the Cd3 gene-deficient mice nearly completely lack in mature T cells, that is, Cd4 and Cd8 single positive cells, while these cells were present in the human CD3 gene-substituted mice at a ratio equivalent to that in the wild-type.

Abundance Ratio of Mature T Cells

TABLE 20

| Experimental group | Number of samples | mCd3 | hCD3 | mCd4 | mCd8 |
| --- | --- | --- | --- | --- | --- |
| Human CD3ε-substituted mouse #1C3 | n = 4 | ND. | 38.8 (±3.1) | 19.6 (±0.7) | 16.1 (±3.6) |
| Human CD3ε-substituted mouse #4HH3 | n = 2 | ND. | 29.8, 28.9 | 15.5, 13.9 | 17.5, 16.4 |
| Human CD3ε-substituted mouse #8I12 | n = 4 | ND. | 31.5 (±5.4) | 15.5 (±3.1) | 15.3 (±2.7) |
| hCD3E Tg mouse | n = 4 | 19.5 (±3.76) | 13.0 (±1.4) | 7.4 (±0.6) | 7.8 (±0.8) |
| Cd3ε-deficient mouse | n = 4 | ND. | ND. | 1.8 (±1.3) | 2.1 (±0.6) |
| C57BL/6N | n = 4 | 40.4 (±8.42) | ND. | 20.3 (±6.7) | 12.7 (±2.1) |

The table shows the expression ratios of the respective marker-positive cells with respect to the spleen cells (unit %). The mean from four individuals is shown for each the experimental group, except for human CD3ε-substituted mice #4HH3, and the expression ratios of two individuals are shown for line #4HH3. (The standard deviation is shown in parenthesis.) ND: not detected.

[Reference Example 11] Evaluation of Immune Function of Human CD3 Gene-Substituted Mice (1) Examination of the Ability to Produce Specific Antibodies in Response to Immunization to Foreign Antigen For production of specific antibodies against foreign antigens, there must exist functional helper T cells that can bind to antigenic peptides presented together with major histocompatibility complex (MHC) antigens on the surface of antigen-presenting cells such as dendritic cells, and the T cells must have functions of giving instructions to antibody-producing cells to produce appropriate antibodies. Whether the above-mentioned human CD3 gene-substituted mice carry helper T cells having normal functions and produce specific antibodies in response to immunization to foreign antigens was examined. Immunization was carried out using chicken ovalbumin (OVA) as the sensitizing antigen together with Freund's adjuvant. Immunization to OVA was performed twice with a four-week interval. More specifically, the first immunization was performed by subcutaneously applying, 100 μg of OVA per animal with complete Freund's adjuvant to the dorsal region, and four weeks later, similar immunization was performed by subcutaneously applying the antigen with incomplete Freund's adjuvant to the dorsal region. As human CD3 gene-substituted mice, two lines (line nos. 1C3 and 8I12), each of which is derived from a different modified ES cell clone, were selected, and compared to human CD3ε-overexpressing mice. Furthermore, as controls, wild-type mice and Cd3 gene-deficient mice were selected and similar antigen immunizations were performed.

Figure 34:
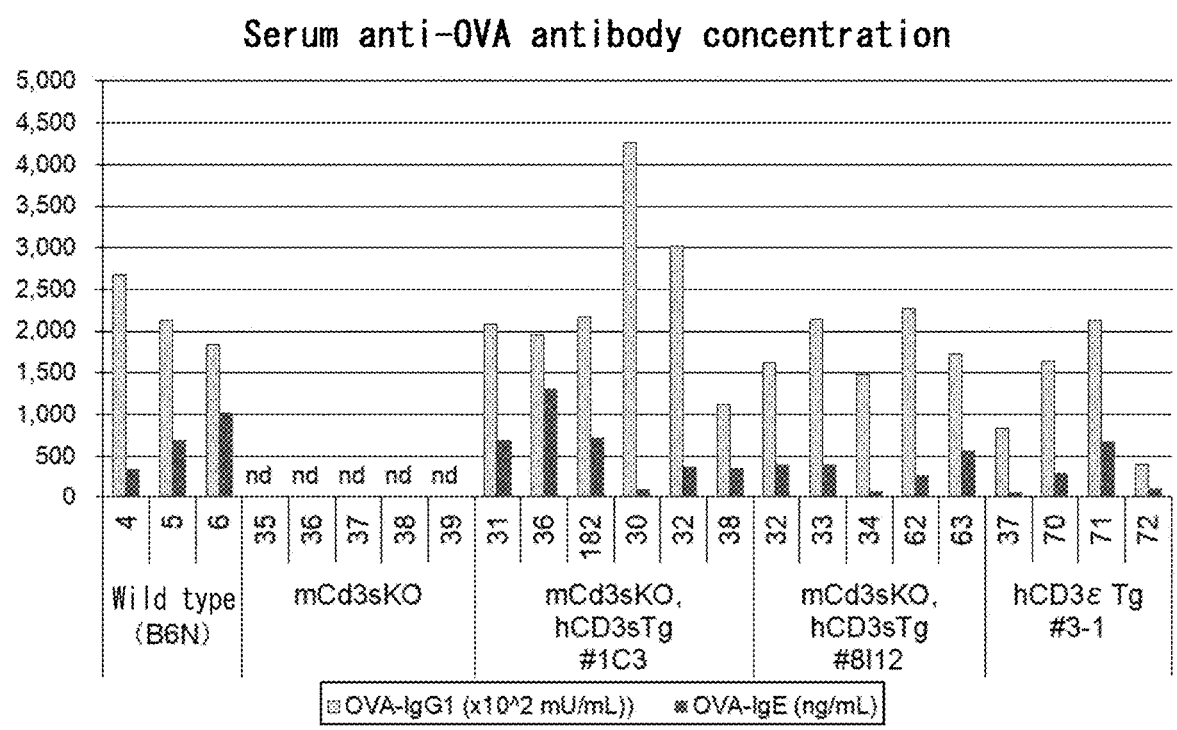
FIG. 34 presents the results of measuring the chicken ovalbumin (OVA)-specific IgG1 and IgE serum concentrations in each established line of human CD3-substituted mice immunized with OVA. The OVA-specific serum IgG1 and IgE concentrations for each individual are shown as a bar graph. The numbers below the bar graph indicate the individual identification numbers.
Figure 35A:
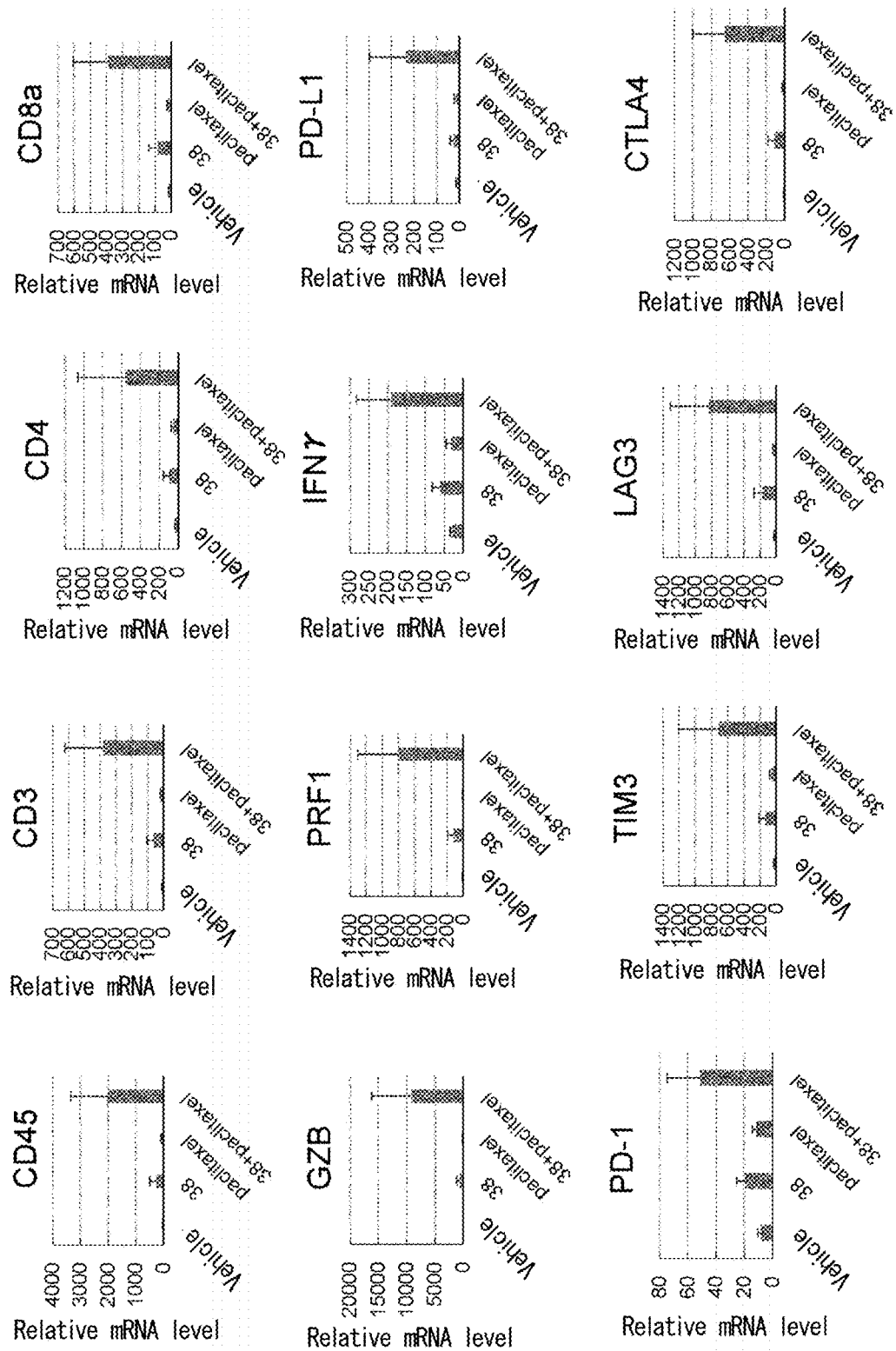
FIG. 35A shows a result of comprehensive RNA analysis of tumor tissues when Paclitaxel and antibody-38 are used in combination.
Figure 35B:
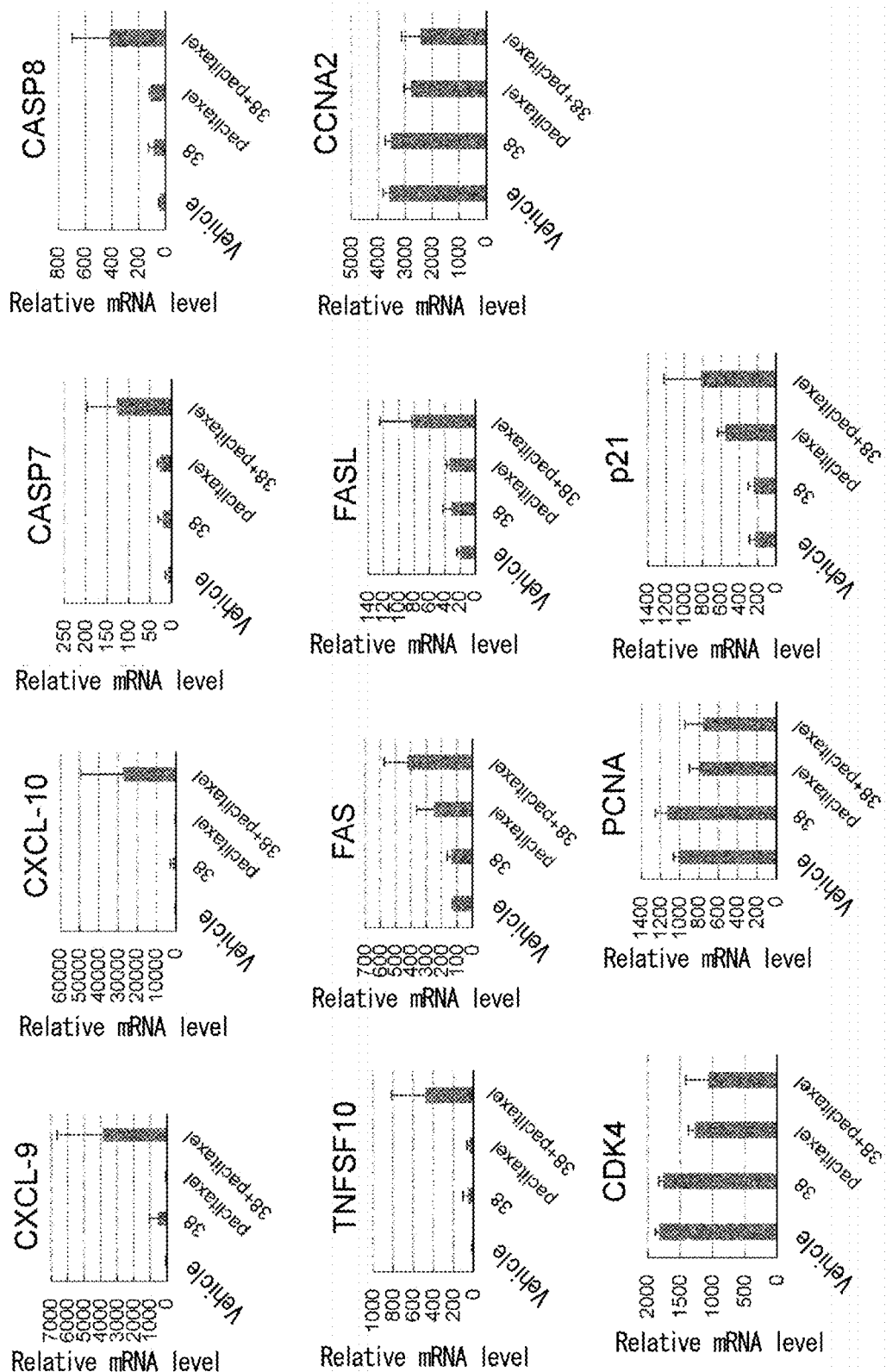
FIG. 35B shows a result of comprehensive RNA analysis of tumor tissues when Paclitaxel and antibody-38 are used in combination (a continuation of FIG. 35-1).
Figure 35C:
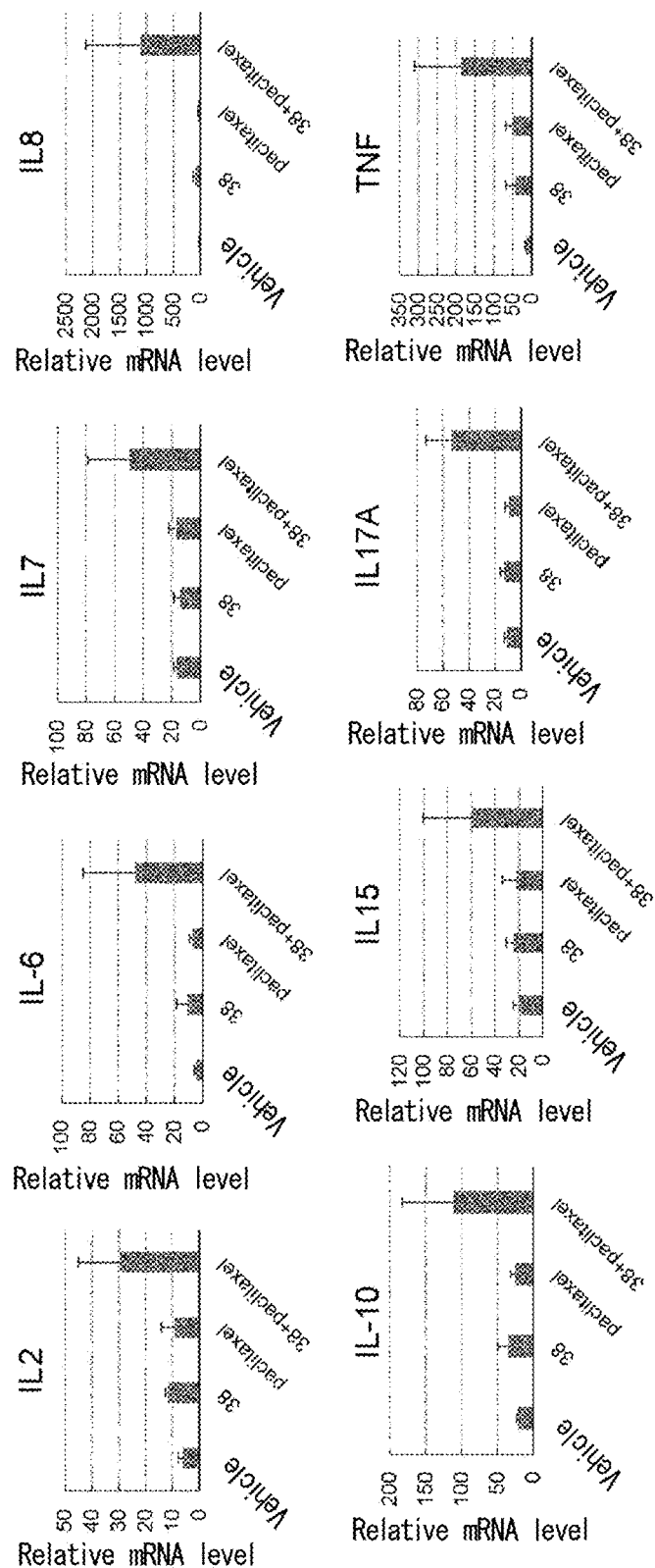
FIG. 35C shows a result of comprehensive RNA analysis of tumor tissues when Paclitaxel and antibody-38 are used in combination (a continuation of FIG. 35-2).
Figure 35D:
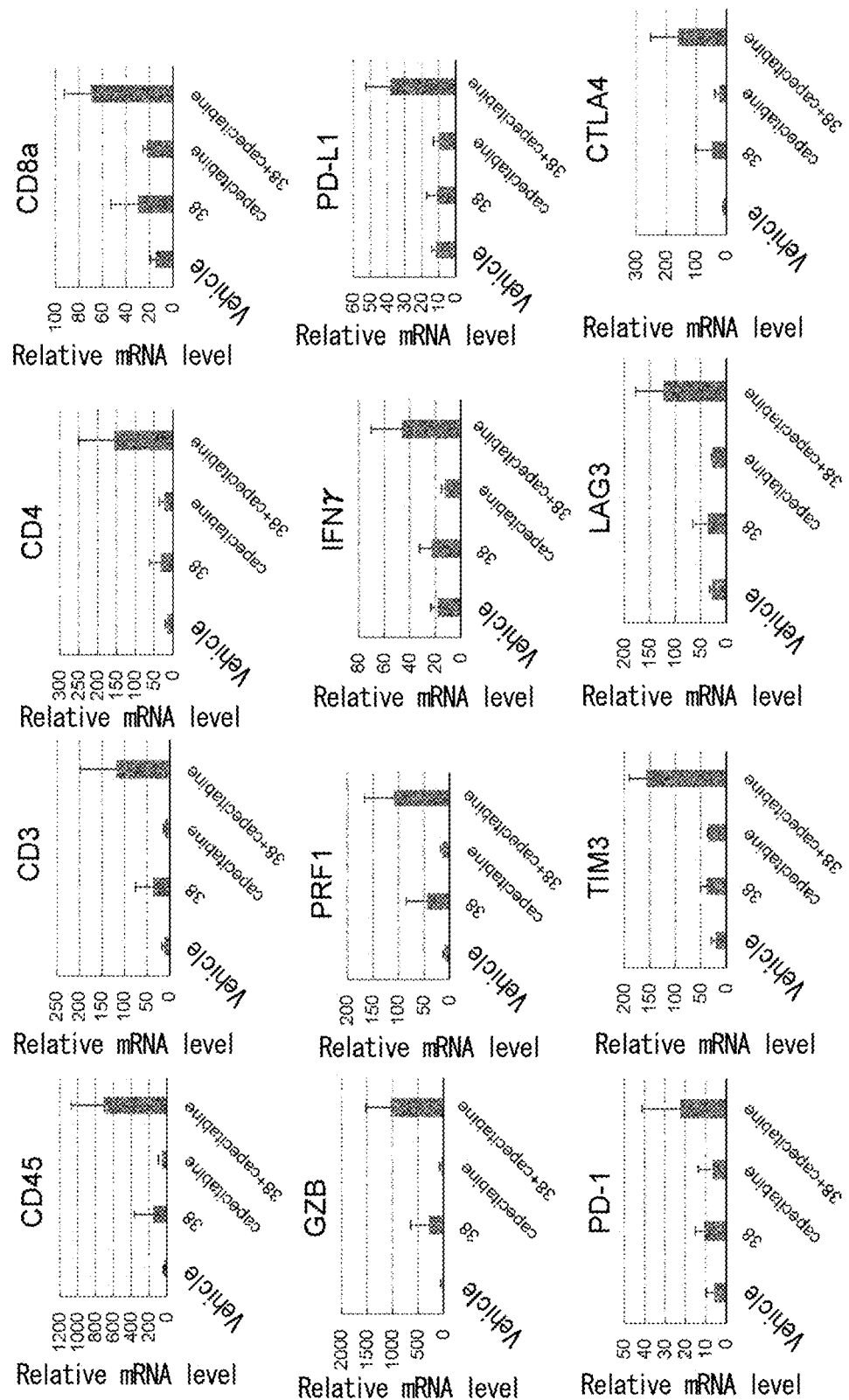
FIG. 35D shows a result of comprehensive RNA analysis of tumor tissues when Capecitabine and antibody-38 are used in combination.
Figure 35E:
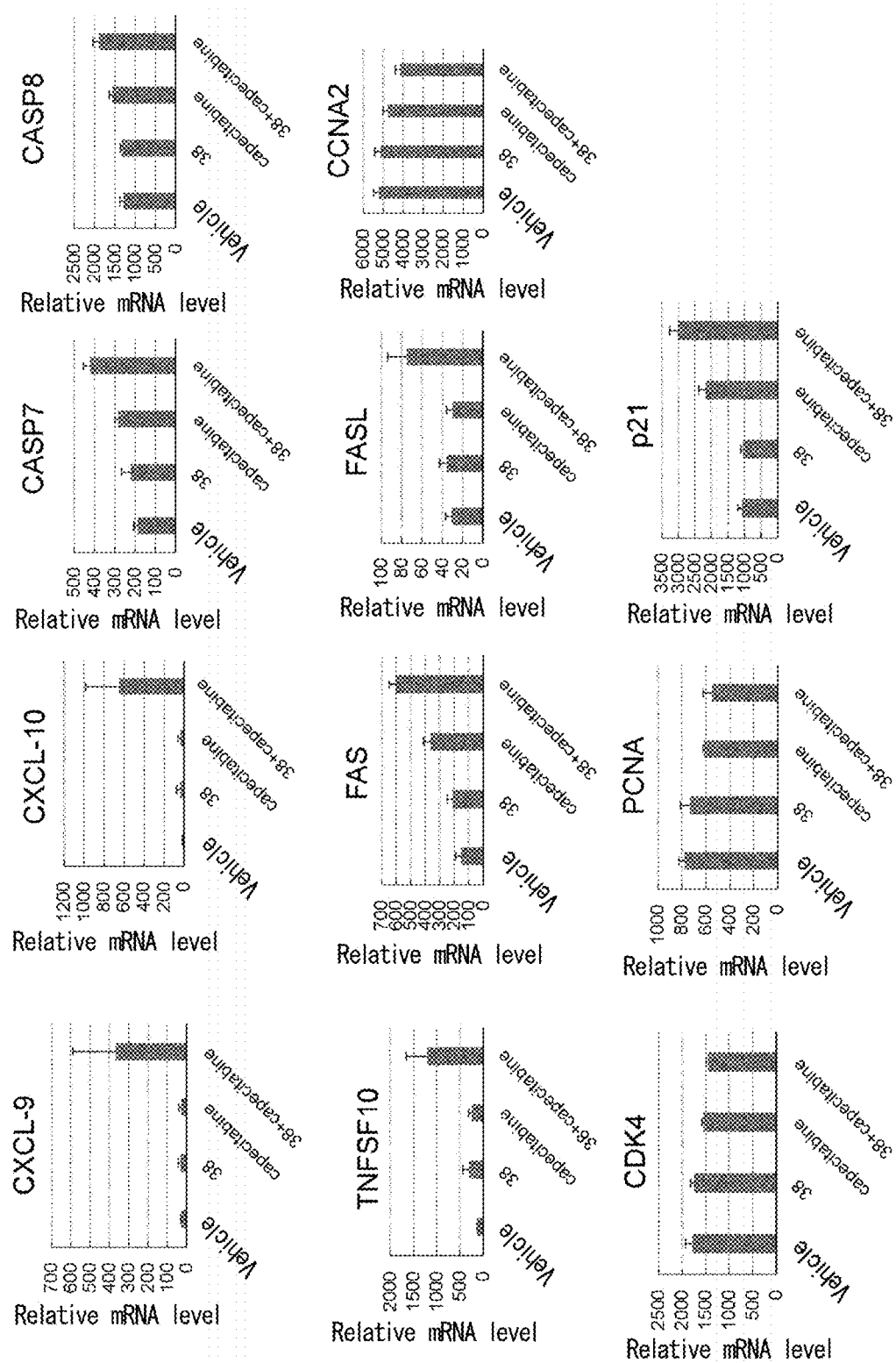
FIG. 35E shows a result of comprehensive RNA analysis of tumor tissues when Capecitabine and antibody-38 are used in combination (a continuation of FIG. 35-4).
Figure 35F:
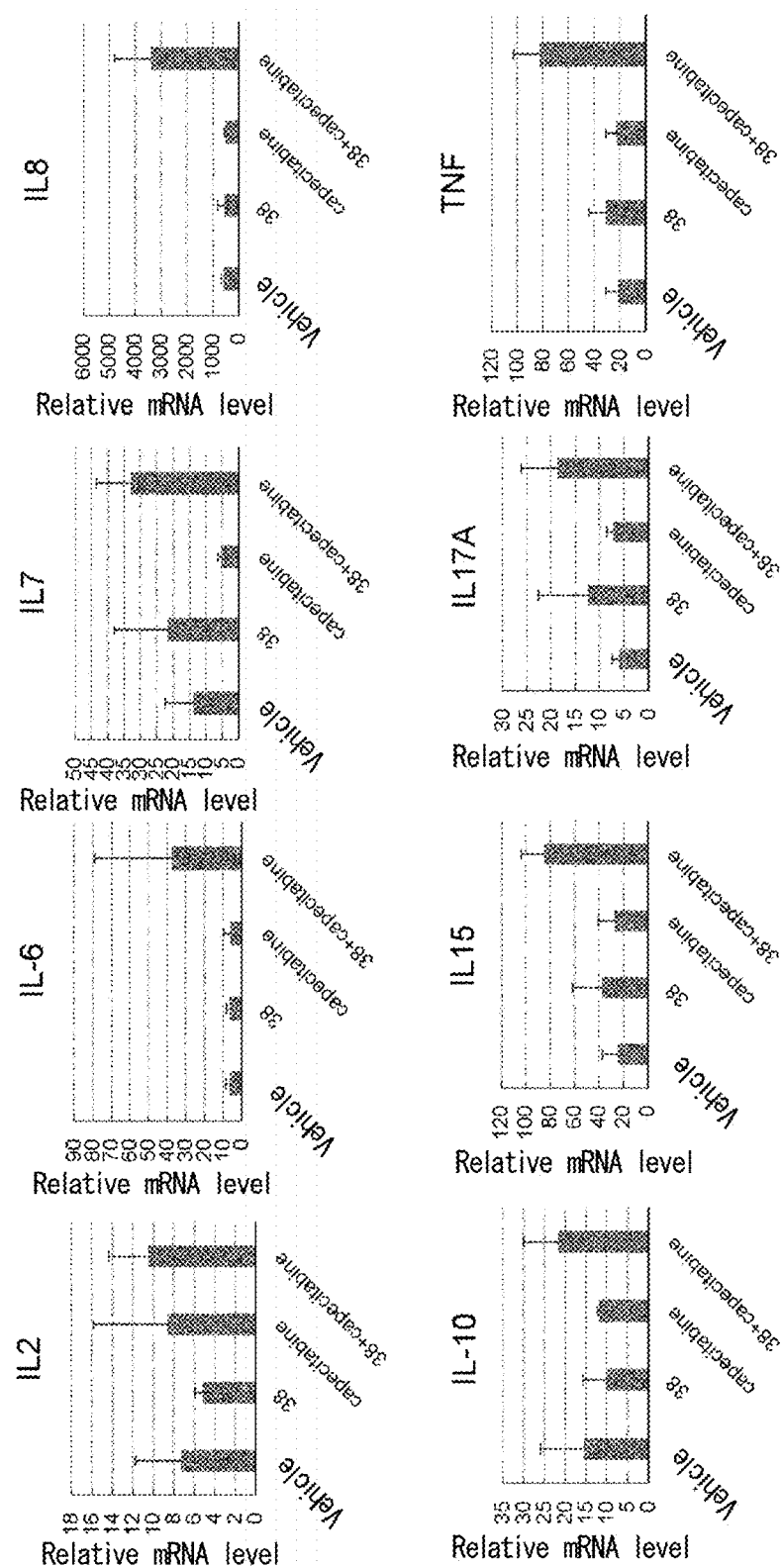
FIG. 35F shows a result of comprehensive RNA analysis of tumor tissues when Capecitabine and antibody-38 are used in combination (a continuation of FIG. 35-5).

One week after the second immunization, the animals were subjected to laparotomy under isoflurane anesthesia, and then euthanized by collecting whole blood and allowing bleeding from the abdominal vena cava. Serum was separated from the collected blood, and the concentrations of OVA-specific IgG1 and OVA-specific IgE were measured (FIG. 34).

As a result, neither IgG1 type nor IgE type OVA-specific antibodies were detected from the serum of mouse Cd3-deficient mice, whereas OVA-specific IgG1 and IgE were detected in both lines of the human CD3 gene-substituted mice, and their levels were equivalent to those of wild-type mice. These results showed that human CD3 gene-substituted mice have normal ability to produce antibodies in response to foreign antigen immunization.

INDUSTRIAL APPLICABILITY

The present invention provides anticancer agents and pharmaceutical compositions for use in combination with another anticancer agent, the agents or compositions comprising novel multispecific antigen-binding molecules that maintain the strong anti-tumor activity possessed by BiTE and the excellent safety property of not inducing a cytokine storm or such independently from cancer antigen, and also have long half-lives in blood. Anticancer agents and pharmaceutical compositions that comprise an antigen-binding molecule of the present invention as an active ingredient can target glypican 3-expressing cells and tumor tissues containing these cells and induce cytotoxicity. Administration of a multispecific antigen-binding molecule of the present invention to patients makes it possible to have a desirable treatment which not only has a high level of safety but also a reduced physical burden, and is highly convenient.

SEQUENCE LISTING (479 sequences)

SEQ ID NO: 1 - DNA, 2398 bp, Homo sapiens
agccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgaaactgagaagaaaatatggcacttcaaatatcctatcttcttcctgtgtatagggctagacttacagattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaaaaaaaaaaaa

SEQ ID NO: 2 - protein, 603 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTETEKKIWHFKYPIFFLCIGLDLQIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 3 - protein, 19 aa, Artificial
  An artificially generated sequence
MGWSCIILFLVATATGVHS

SEQ ID NO: 4 - protein, 141 aa, Homo sapiens
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 5 - protein, 179 aa, Homo sapiens
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 6 - protein, 173 aa, Homo sapiens
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 7 - protein, 204 aa, Homo sapiens
KQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKDSYSKDANDVTTVDPKYNYSKDANDVITMDPKDNWSKDANDTLLLQLTNTSAYYMYLLLLLKSVVYFAIITCCLLGRTAFCCNGEKS

SEQ ID NO: 8 - protein, 177 aa, Homo sapiens
PSYTGGYADKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 9 - DNA, 1311 bp, Homo sapiens
agtctagctgctgcacaggctggctggctggctggctgctaagggctgctccacgcttttgccggaggacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctc

SEQ ID NO: 10 - DNA, 771 bp, Homo sapiens
agagaagcagacatcttctagttcctcccccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcagaaaaaaaaaaaaaaaaaaaaaaaaaaaaaa

SEQ ID NO: 11 - DNA, 1534 bp, Homo sapiens
tattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagaaaaaaaaaaaaaaaaaaaaaa

SEQ ID NO: 12 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 13 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 14 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 15 - protein, 4 aa, Artificial
  An artificially generated sequence
GGGS

SEQ ID NO: 16 - protein, 4 aa, Artificial
  An artificially generated sequence
SGGG

SEQ ID NO: 17 - protein, 5 aa, Artificial
  An artificially generated sequence
GGGGS

SEQ ID NO: 18 - protein, 5 aa, Artificial
  An artificially generated sequence
SGGGG

SEQ ID NO: 19 - protein, 6 aa, Artificial
  An artificially generated sequence
GGGGGS

SEQ ID NO: 20 - protein, 6 aa, Artificial
  An artificially generated sequence
SGGGGG

SEQ ID NO: 21 - protein, 7 aa, Artificial
  An artificially generated sequence
GGGGGGS

SEQ ID NO: 22 - protein, 7 aa, Artificial
  An artificially generated sequence
SGGGGGG

SEQ ID NO: 23 - protein, 330 aa, Homo sapiens [sequence omitted]

SEQ ID NO: 24 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 25 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 26 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 27 - DNA, 2268 bp, Homo sapiens
aatatcttgcatgttacagatttcactgctcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28 - protein, 374 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 29 - DNA, 1396 bp, Homo sapiens
gggatgactatggagacccaaatgtctcagaatgtatgtcccagaaacctgtggctgcttcaaccattgacagttttgctgctgctggcttctgcagacagtcaagctgctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatgggggtcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgactaaaaaaaaaaaaaaaaaaaaaaaaaaaaaa

SEQ ID NO: 30 - protein, 316 aa, Homo sapiens
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGVIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 31 - DNA, 1497 bp, Homo sapiens
tgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 32 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 33 - DNA, 2137 bp, Homo sapiens
cttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagttgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttgtcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 34 - protein, 254 aa, Homo sapiens [sequence omitted]

SEQ ID NO: 35 - DNA, 820 bp, Homo sapiens
cactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcag

SEQ ID NO: 36 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 37 - protein, 330 aa, Homo sapiens [sequence omitted]

SEQ ID NO: 38 - protein, 326 aa, Homo sapiens; identical to SEQ ID NO: 24

SEQ ID NO: 39 - protein, 327 aa, Homo sapiens; identical to SEQ ID NO: 26

SEQ ID NO: 40 - protein, 115 aa, Artificial
  An artificially generated sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSS

SEQ ID NO: 41 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCSQNTHVPPTFGQGTKLEIK

SEQ ID NO: 42 - protein, 122 aa, Rattus norvegicus
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSS

SEQ ID NO: 43 - protein, 112 aa, Rattus norvegicus
DVVMTQTPVSMSVSLGGQVSISCRSSQSLVHNNGNTYVSWYIQKPSQSPQLLIYKVSNRFSGISDRFSGSGSGTDFTLKISRVEPDDLGVYYCGQGTQDPYTFGAGTKLELK

SEQ ID NO: 44 - protein, 328 aa, Artificial
  An artificially generated sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 45 - protein, 338 aa, Artificial
  An artificially generated sequence
SSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPHHHHHHHH

SEQ ID NO: 46 - protein, 336 aa, Artificial
  An artificially generated sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 47 - protein, 450 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCSQNTHVPPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPHHHHHHHH

SEQ ID NO: 48 - protein, 222 aa, Artificial
  An artificially generated sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 458 aa, Artificial
  An artificially generated sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 50 - protein, 219 aa, Artificial
  An artificially generated sequence
DVVMTQTPVSMSVSLGGQVSISCRSSQSLVHNNGNTYVSWYIQKPSQSPQLLIYKVSNRFSGISDRFSGSGSGTDFTLKISRVEPDDLGVYYCGQGTQDPYTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCARVHYGAYYGVDAWGQGTTVTVSS

SEQ ID NO: 52 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSS

SEQ ID NO: 53 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 54 - protein, 448 aa, Artificial
  An artificially generated sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSRLTVDKSRWQEGNVFSCSVMHEALHNRYTQKSLSLSLHHHHHHHH

SEQ ID NO: 55 - protein, 455 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQESLSLSLDYKDDDDK

SEQ ID NO: 56 - protein, 219 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 336 aa, Artificial; identical to SEQ ID NO: 46
  An artificially generated sequence

SEQ ID NO: 58 - protein, 338 aa, Artificial; identical to SEQ ID NO: 45
  An artificially generated sequence

SEQ ID NO: 59 - protein, 230 aa, Artificial
  An artificially generated sequence
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNRYTQKSLSLSP

SEQ ID NO: 60 - protein, 325 aa, Artificial
  An artificially generated sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 61 - protein, 325 aa, Artificial
  An artificially generated sequence
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 62 - protein, 325 aa, Artificial
  An artificially generated sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 63 - protein, 107 aa, Artificial [sequence omitted]

SEQ ID NO: 64 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYGAYYGVDAWGQGTTVTVSS

SEQ ID NO: 65 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRDDSKNSIYLQMNSLKTEDTAVYYCRYVHYGAYYGVQAWGQGTTVTVSS

SEQ ID NO: 66 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYGAYYGVQAWGQGTTVTVSS

SEQ ID NO: 67 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRADSKNSLYLQMNSLKTEDTAVYYCRYVHYGAYYGVQAWGQGTTVTVSS

SEQ ID NO: 68 - protein, 122 aa, Artificial
  An artificially generated sequence
QVQLVESGGGVVQPGGSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSS

SEQ ID NO: 69 - protein, 122 aa, Artificial
  An artificially generated sequence
QVQLVESGGGLVQPGRSLRLSCAASGFTFSNAWMHWVRQAPGKGLEWVAQIKAKSQNYATYYAESVKGRFTISRADSKNSIYLQMNSLKTEDTAVYYCRYVHYGAYYGVDIWGQGTTVTVSS

SEQ ID NO: 70 - protein, 122 aa, Artificial
  An artificially generated sequence
QVQLVESGGGLVQPGRSLRLSCAASGFTFSNAWMHWVRQAPGKGLEWVAQIKSKSNNYATYYAESVKGRFTISRADSKNSIYLQMNSLKTEDTAVYYCRYVHYGAYYGVDIWGQGTTVTVSS

SEQ ID NO: 71 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYGAYYGVDIWGQGTTVTVSS

SEQ ID NO: 72 - protein, 122 aa, Artificial
  An artificially generated sequence
QVQLVESGGGLVQPGRSLRLSCAASGFTFSNAWMHWVRQAPGKGLEWVAQIKAKSNNYATYYAPSVKGRFTISRADSKNSIYLQMNSLKTEDTAVYYCRYVHYGAYYGVDIWGQGTTVTVSS

SEQ ID NO: 73 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYSAYYGVDIWGQGTTVTVSS

SEQ ID NO: 74 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYGASYGVDIWGQGTTVTVSS

SEQ ID NO: 75 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYYYSYGVDIWGQGTTVTVSS

SEQ ID NO: 76 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYGAYYGVDIWGQGTTVTVSS

SEQ ID NO: 77 - protein, 122 aa, Artificial
  An artificially generated sequence
QVQLVESGGGLVQPGRSLRLSCAASGFTFSNAWMHWVRQAPGKGLEWVAQIKGKSNNYATYYAPSVKGRFTISRADSKNSIYLQMNSLKTEDTAVYYCRYVHYGAYYGVDIWGQGTTVTVSS

SEQ ID NO: 78 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 79 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSYSYGVDIWGQGTTVTVSS

SEQ ID NO: 80 - protein, 122 aa, Artificial
  An artificially generated sequence
QVQLVESGGGLVQPGGSLRLSCAASGFTFSNAWMHWVRQAPGKGLEWVAQIKAKSNNYATYYAESVKGRFTISRADSKNSIYLQMNSLKTEDTAVYYCRYVHYGAYYGVDIWGQGTTVTVSS

SEQ ID NO: 81 - protein, 122 aa, Artificial
  An artificially generated sequence
QVQLVESGGGLVQPGGSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 82 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYSASYGVDIWGQGTTVTVSS

SEQ ID NO: 83 - protein, 122 aa, Artificial
  An artificially generated sequence
QVQLVESGGGLVQPGRSLRLSCAASGFTFSNAWMHWVRQAPGKGLEWVAQIKGKSNNYATYYAPSVKGRFTISRADSKNSIYLQMNSLKTEDTAVYYCRYVHYSASYGVDIWGQGTTVTVSS

SEQ ID NO: 84 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDAWGQGTTVTVSS

SEQ ID NO: 85 - protein, 122 aa, Artificial
  An artificially generated sequence
QVQLVESGGGLVQPGGSLRLSCAASGFTFSNAWMHWVRQAPGKGLEWVAQIKGKSQNYATYYAPSVKGRFTISRADSKNSIYLQMNSLKTEDTAVYYCRYVHYSASYGVDIWGQGTTVTVSS

SEQ ID NO: 86 - protein, 122 aa, Artificial
  An artificially generated sequence
QVQLVESGGGLVQPGGSLRLSCAASGFTFSNAWMHWVRQAPGKGLEWVAQIKGKSQNYATYYAESVKGRFTISRADSKNSIYLQMNSLKTEDTAVYYCRYVHYSASYGVDIWGQGTTVTVSS

SEQ ID NO: 87 - protein, 122 aa, Artificial
  An artificially generated sequence
QVQLVESGGGLVQPGGSLRLSCAASGFTFSNAWMHWVRQAPGKGLEWVAQIKGKSQNYATYYAESVKGRFTISRADSKNSIYLQMNSLKTEDTAVYYCRYVHYSASYGVDAWGQGTTVTVSS

SEQ ID NO: 88 - protein, 122 aa, Artificial
  An artificially generated sequence
QVQLVESGGGLVQPGRSLRLSCAASGFTFSNAWMHWVRQAPGKGLEWVAQIKSKSQNYATYYAESVKGRFTISRADSKNSIYLQMNSLKTEDTAVYYCRYVHYSASYGVDIWGQGTTVTVSS

SEQ ID NO: 89 - protein, 122 aa, Artificial
  An artificially generated sequence
QVQLVESGGGLVQPGGSLRLSCAASGFTFSNAWMHWVRQAPGKGLEWVAQIKSKSQNYATYYAESVKGRFTISRADSKNSIYLQMNSLKTEDTAVYYCRYVHYSASYGVDIWGQGTTVTVSS

SEQ ID NO: 90 - protein, 122 aa, Artificial
  An artificially generated sequence
QVQLVESGGGLVQPGGSLRLSCAASGFTFSNAWMHWVRQAPGKGLEWVAQIKSKSQNYATYYAESVKGRFTISRADSKNSIYLQMNSLKTEDTAVYYCRYVHYSASYGVDAWGQGTTVTVSS

SEQ ID NO: 91 - protein, 122 aa, Artificial
  An artificially generated sequence
QVQLVESGGGVVQPGGSLRLSCAASGFTFSNAWMHWVRQAPGKGLEWVAQIKSKSQNYATYYAESVKGRFTISRADSKNSIYLQMNSLKTEDTAVYYCRYVHYSASYGVDIWGQGTTVTVSS

SEQ ID NO: 92 - protein, 122 aa, Artificial
  An artificially generated sequence
QVQLVESGGGLVQPGRSLRLSCSASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 93 - protein, 122 aa, Artificial
  An artificially generated sequence
QVQLVESGGGVVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 94 - protein, 122 aa, Artificial
  An artificially generated sequence
QVQLVESGGGVVQPGGSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 95 - protein, 122 aa, Artificial
  An artificially generated sequence
QVQLVESGGGLVQPGRSLRLSCAASGFTFSNAWMHWVRQAPGKGLEWVAQIKSKSQNYATYYAESVKGRFTISRADSKNSIYLQMNSLKTEDTAVYYCRYVHYSASYGVDAWGQGTTVTVSS

SEQ ID NO: 96 - protein, 122 aa, Artificial
  An artificially generated sequence
QVQLVESGGGLVQPGRSLRLSCAASGFTFSNAWMHWVRQAPGKGLEWVAQIKSKSQNYATYYAESVKGRFTISRADSKNSIYLQMNSLKTEDTAVYYCRYVHYSASYGVDYWGQGTTVTVSS

SEQ ID NO: 97 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYSASYGVDAWGQGTTVTVSS

SEQ ID NO: 98 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYSASYGVDYWGQGTTVTVSS

SEQ ID NO: 99 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDYWGQGTTVTVSS

SEQ ID NO: 100 - protein, 122 aa, Artificial
  An artificially generated sequence
QVQLVESGGGLVQPGRSLRLSCAASGFTFSNAWMPWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 101 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYSASYGVDIWGQGTTVTVSS

SEQ ID NO: 102 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDIWGQGTTVTVSS

SEQ ID NO: 103 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSS

SEQ ID NO: 104 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDYWGQGTTVTVSS

SEQ ID NO: 105 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSS

SEQ ID NO: 106 - protein, 122 aa, Artificial
  An artificially generated sequence
QVQLVESGGGLVQPGRSLRLSCSASGFTFSNAWMHWVRQAPGKGLEWVAQIKDKSNNYATYYAESVKGRFTISRADSKNSIYLQMNSLKTEDTAVYYCRYVHYSASYGVDIWGQGTTVTVSS

SEQ ID NO: 107 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYSASYGVDIWGQGTTVTVSS

SEQ ID NO: 108 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSS

SEQ ID NO: 109 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYSASYGVDYWGQGTTVTVSS

SEQ ID NO: 110 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRDDSKNSIYLQMNSLKTEDTAVYYCRYVHYSASYGVDIWGQGTTVTVSS

SEQ ID NO: 111 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYSASYGVDIWGQGTTVTVSS

SEQ ID NO: 112 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYSASYGVDAWGQGTTVTVSS

SEQ ID NO: 113 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYSASYGVDYWGQGTTVTVSS

SEQ ID NO: 114 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSLYLQMNSLKTEDTAVYYCRYVHYSASYGVDIWGQGTTVTVSS

SEQ ID NO: 115 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYSASYGVDIWGQGTTVTVSS

SEQ ID NO: 116 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYSASYGVDAWGQGTTVTVSS

SEQ ID NO: 117 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYSASYGVDYWGQGTTVTVSS

SEQ ID NO: 118 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRDDSKNSLYLQMNSLKTEDTAVYYCRYVHYSASYGVDIWGQGTTVTVSS

SEQ ID NO: 119 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYSASYGVDIWGQGTTVTVSS

SEQ ID NO: 120 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYSASYGVDAWGQGTTVTVSS

SEQ ID NO: 121 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYSASYGVDYWGQGTTVTVSS

SEQ ID NO: 122 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAASYGVDIWGQGTTVTVSS

SEQ ID NO: 123 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAASYGVDAWGQGTTVTVSS

SEQ ID NO: 124 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAASYGVDAWGQGTTVTVSS

SEQ ID NO: 125 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYAASYGVDAWGQGTTVTVSS

SEQ ID NO: 126 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYAASYGVDAWGQGTTVTVSS

SEQ ID NO: 127 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYAASYGVDAWGQGTTVTVSS

SEQ ID NO: 128 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSS

SEQ ID NO: 129 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSS

SEQ ID NO: 130 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDIWGQGTTVTVSS

SEQ ID NO: 131 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDYWGQGTTVTVSS

SEQ ID NO: 132 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAASYGVDIWGQGTTVTVSS

SEQ ID NO: 133 - protein, 122 aa, Artificial; identical to SEQ ID NO: 122
  An artificially generated sequence

SEQ ID NO: 134 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDIWGQGTTVTVSS

SEQ ID NO: 135 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAASYGVDIWGQGTTVTVSS

SEQ ID NO: 136 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDYWGQGTTVTVSS

SEQ ID NO: 137 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAASYGVDYWGQGTTVTVSS

SEQ ID NO: 138 - protein, 124 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAAEMVRDDIWGQGTTVTVSS

SEQ ID NO: 139 - protein, 128 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAAEMVRDSYGVDIWGQGTTVTVSS

SEQ ID NO: 140 - protein, 128 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAVRRRLSSYGVDIWGQGTTVTVSS

SEQ ID NO: 141 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSS

SEQ ID NO: 142 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 143 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAGYGVDIWGQGTTVTVSS

SEQ ID NO: 144 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSS

SEQ ID NO: 145 - protein, 122 aa, Artificial
  An artificially generated sequence
QVQLVESGGGLVQPGGSLRLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 146 - protein, 122 aa, Artificial
  An artificially generated sequence
QVQLVESGGGLVQPGRSLKLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 147 - protein, 122 aa, Artificial
  An artificially generated sequence
QVQLVESGGGLVQPGRSLRLSCAASGFTFSNAWMHWVRQAPGKGLEWVAQIKDKSQNYATYYAESVAGRFTISRDDSKNSLYLQMNSLKTEDTAVYYCRYVHYAAGYGVDAWGQGTTVTVSS

SEQ ID NO: 148 - protein, 122 aa, Artificial
  An artificially generated sequence
QVQLVESGGGLVQPGRSLRLSCAASGFTFSNAWMHWVRQAPGKGLEWVAQIKDKSQNYATYYAESVQGRFTISRDDSKNSLYLQMNSLKTEDTAVYYCRYVHYAAGYGVDAWGQGTTVTVSS

SEQ ID NO: 149 - protein, 122 aa, Artificial
  An artificially generated sequence
QVQLVESGGGLVQPGRSLRLSCAASGFTFSNAWMHWVRQAPGKGLEWVAQIKDKSQNYATYYAESVSGRFTISRDDSKNSLYLQMNSLKTEDTAVYYCRYVHYAAGYGVDAWGQGTTVTVSS

SEQ ID NO: 150 - protein, 122 aa, Artificial
  An artificially generated sequence
QVQLVESGGGLVQPGRSLRLSCAASGFTFSNAWMHWVRQAPGKGLEWVAQIKDKSQNYAFYYAESVKGRFTISRDDSKNSLYLQMNSLKTEDTAVYYCRYVHYAAGYGVDAWGQGTTVTVSS

SEQ ID NO: 151 - protein, 122 aa, Artificial
  An artificially generated sequence
QVQLVESGGGLVQPGRSLRLSCAASGFTFSNAWMHWVRQAPGKGLEWVAQIKDKSQNYAGYYAESVKGRFTISRDDSKNSLYLQMNSLKTEDTAVYYCRYVHYAAGYGVDAWGQGTTVTVSS

SEQ ID NO: 152 - protein, 122 aa, Artificial
  An artificially generated sequence
QVQLVESGGGLVQPGRSLRLSCAASGFTFSNAWMHWVRQAPGKGLEWVAQIKDKSQNYALYYAESVKGRFTISRDDSKNSLYLQMNSLKTEDTAVYYCRYVHYAAGYGVDAWGQGTTVTVSS

SEQ ID NO: 153 - protein, 122 aa, Artificial
  An artificially generated sequence
QVQLVESGGGLVQPGRSLRLSCAASGFTFSNAWMHWVRQAPGKGLEWVAQIKDKSQNYAPYYAESVKGRFTISRDDSKNSLYLQMNSLKTEDTAVYYCRYVHYAAGYGVDAWGQGTTVTVSS

SEQ ID NO: 154 - protein, 122 aa, Artificial
  An artificially generated sequence
QVQLVESGGGLVQPGRSLRLSCAASGFTFSNAWMHWVRQAPGKGLEWVAQIKDKSQNYAQYYAESVKGRFTISRDDSKNSLYLQMNSLKTEDTAVYYCRYVHYAAGYGVDAWGQGTTVTVSS

SEQ ID NO: 155 - protein, 122 aa, Artificial
  An artificially generated sequence
QVQLVESGGGLVQPGRSLRLSCAASGFTFSNAWMHWVRQAPGKGLEWVAQIKDKSQNYASYYAESVKGRFTISRDDSKNSLYLQMNSLKTEDTAVYYCRYVHYAAGYGVDAWGQGTTVTVSS

SEQ ID NO: 156 - protein, 122 aa, Artificial
  An artificially generated sequence
QVQLVESGGGLVQPGRSLRLSCAASGFTFSNAWMHWVRQAPGKGLEWVAQIKDKSQNYAVYYAESVKGRFTISRDDSKNSLYLQMNSLKTEDTAVYYCRYVHYAAGYGVDAWGQGTTVTVSS

SEQ ID NO: 157 - protein, 122 aa, Artificial
  An artificially generated sequence
QVQLVESGGGLVQPGRSLRLSCAASGFTFSNAWMHWVRQAPGKGLEWVAQIKDKSQNYATYFAESVKGRFTISRDDSKNSLYLQMNSLKTEDTAVYYCRYVHYAAGYGVDAWGQGTTVTVSS

SEQ ID NO: 158 - protein, 122 aa, Artificial
  An artificially generated sequence
QVQLVESGGGLVQPGRSLRLSCAASGFTFSNAWMHWVRQAPGKGLEWVAQIKDKSQNYATYGAESVKGRFTISRDDSKNSLYLQMNSLKTEDTAVYYCRYVHYAAGYGVDAWGQGTTVTVSS

SEQ ID NO: 159 - protein, 122 aa, Artificial
  An artificially generated sequence
QVQLVESGGGLVQPGRSLRLSCAASGFTFSNAWMHWVRQAPGKGLEWVAQIKDKSQNYATYIAESVKGRFTISRDDSKNSLYLQMNSLKTEDTAVYYCRYVHYAAGYGVDAWGQGTTVTVSS

SEQ ID NO: 160 - protein, 122 aa, Artificial
  An artificially generated sequence
QVQLVESGGGLVQPGRSLRLSCAASGFTFSNAWMHWVRQAPGKGLEWVAQIKDKSQNYATYLAESVKGRFTISRDDSKNSLYLQMNSLKTEDTAVYYCRYVHYAAGYGVDAWGQGTTVTVSS

SEQ ID NO: 161 - protein, 122 aa, Artificial
  An artificially generated sequence
QVQLVESGGGLVQPGRSLRLSCAASGFTFSNAWMHWVRQAPGKGLEWVAQIKDKSQNYATYPAESVKGRFTISRDDSKNSLYLQMNSLKTEDTAVYYCRYVHYAAGYGVDAWGQGTTVTVSS

SEQ ID NO: 162 - protein, 122 aa, Artificial
  An artificially generated sequence
QVQLVESGGGLVQPGRSLRLSCAASGFTFSNAWMHWVRQAPGKGLEWVAQIKDKSQNYATYQAESVKGRFTISRDDSKNSLYLQMNSLKTEDTAVYYCRYVHYAAGYGVDAWGQGTTVTVSS

SEQ ID NO: 163 - protein, 122 aa, Artificial
  An artificially generated sequence
QVQLVESGGGLVQPGRSLRLSCAASGFTFSNAWMHWVRQAPGKGLEWVAQIKDKSQNYATYTAESVKGRFTISRDDSKNSLYLQMNSLKTEDTAVYYCRYVHYAAGYGVDAWGQGTTVTVSS

SEQ ID NO: 164 - protein, 122 aa, Artificial
  An artificially generated sequence
QVQLVESGGGLVQPGRSLRLSCAASGFTFSNAWMHWVRQAPGKGLEWVAQIKDKSQNYATYVAESVKGRFTISRDDSKNSLYLQMNSLKTEDTAVYYCRYVHYAAGYGVDAWGQGTTVTVSS

SEQ ID NO: 165 - protein, 122 aa, Artificial
  An artificially generated sequence
QVQLVESGGGVVQPGRSLKLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 166 - protein, 122 aa, Artificial
  An artificially generated sequence
QVQLVESGGGVVQPGGSLKLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSS

SEQ ID NO: 167 - protein, 122 aa, Artificial
  An artificially generated sequence
QVQLVESGGGVVQPGGSLRLSCAASGFTFSNAWMHWVRQAPGKGLEWVAQIKDKSQNYAQYYAESVKGRFTISRADSKNSIYLQMNSLKTEDTAVYYCRYVHYAAGYGVDIWGQGTTVTVSS

SEQ ID NO: 168 - protein, 122 aa, Artificial
  An artificially generated sequence
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSS

SEQ ID NO: 169 - protein, 122 aa, Artificial
  An artificially generated sequence
QVQLVESGGGVVQPGGSLRLSCAASGFTFSNAWMHWVRQAPGKGLEWVAQIKDKSQNYASYYAESVKGRFTISRADSKNSIYLQMNSLKTEDTAVYYCRYVHYAAGYGVDIWGQGTTVTVSS

SEQ ID NO: 170 - protein, 115 aa, Artificial
  An artificially generated sequence
QVQLVQSGAEVKKPGASVKVSCKASGYTFTDYEMHWIRQPPGQGLEWIGAIDGDTPDTAYSQKFKGRVTLTADKSTSTAYMELSSLTSEDTAVYYCTRFYSYTYWGQGTLVTVSS

SEQ ID NO: 171 - protein, 115 aa, Artificial
  An artificially generated sequence
QVQLVQSGAEVKKPGASVKVSCKASGYTFTDYEMHWIRQPPGQGLEWIGAIDGKTPDTAESQKFKGRVTLTADKSTSTAYMELSSLTSEDTAVYYCTRFYSYTYWGQGTLVTVSS

SEQ ID NO: 172 - protein, 115 aa, Artificial
  An artificially generated sequence
QVQLVQSGAEVKKPGASVKVSCKASGYTFTDYEMHWIRQPPGQGLEWIGAIDGKTPDTAYEQKFKGRVTLTADKSTSTAYMELSSLTSEDTAVYYCTRFYSYTYWGQGTLVTVSS

SEQ ID NO: 173 - protein, 115 aa, Artificial
  An artificially generated sequence
QVQLVQSGAEVKKPGASVKVSCKASGYTFTDYEMHWIRQPPGQGLEWIGAIDGKTPDTAYSDKFKGRVTLTADKSTSTAYMELSSLTSEDTAVYYCTRFYSYTYWGQGTLVTVSS

SEQ ID NO: 174 - protein, 115 aa, Artificial
  An artificially generated sequence
QVQLVQSGAEVKKPGASVKVSCKASGYTFTDYEMHWIRQPPGQGLEWIGAIDGETPDTAYSQKFKGRVTLTADKSTSTAYMELSSLTSEDTAVYYCTRFYSYTYWGQGTLVTVSS

SEQ ID NO: 175 - protein, 115 aa, Artificial
  An artificially generated sequence
QVQLVQSGAEVKKPGASVKVSCKASGYTFTDYEMHWIRQPPGQGLEWIGAIDGDTPDTAYEQKFKGRVTLTADKSTSTAYMELSSLTSEDTAVYYCTRFYSYTYWGQGTLVTVSS

SEQ ID NO: 176 - protein, 115 aa, Artificial
  An artificially generated sequence
QVQLVQSGAEVKKPGASVKVSCKASGYTFTDYEMHWIRQPPGQGLEWIGAIDGKTPDTAEEQKFKGRVTLTADKSTSTAYMELSSLTSEDTAVYYCTRFYSYTYWGQGTLVTVSS

SEQ ID NO: 177 - protein, 115 aa, Artificial
  An artificially generated sequence
QVQLVQSGAEVKKPGASVTVSCKASGYTFTDYEMHWIRQPPGQGLEWIGAIDGKTPDTAYEQKFKGRVTLTADKSTSTAYMELSSLTSEDTAVYYCTRFYSYTYWGQGTLVTVSS

SEQ ID NO: 178 - protein, 115 aa, Artificial
  An artificially generated sequence
QVQLVQSGAEVKKPGASVKVSCKASGYTFTDYEMHWIRQPPGEGLEWIGAIDGKTPDTAYEQKFKGRVTLTADKSTSTAYMELSSLTSEDTAVYYCTRFYSYTYWGQGTLVTVSS

SEQ ID NO: 179 - protein, 115 aa, Artificial
  An artificially generated sequence
QVQLVQSGAEVKKPGASVKVSCKASGYTFTDYEMHWIRQPPGQGLEWIGAIDGKTPDTAYEESFKGRVTLTADKSTSTAYMELSSLTSEDTAVYYCTRFYSYTYWGQGTLVTVSS

SEQ ID NO: 180 - protein, 115 aa, Artificial
  An artificially generated sequence
QVQLVQSGAEVKKPGASVKVSCKASGYTFTDYEMHWIRQPPGQGLEWIGAIDGKTPDTAYEQKFQDRVTLTADKSTSTAYMELSSLTSEDTAVYYCTRFYSYTYWGQGTLVTVSS

SEQ ID NO: 181 - protein, 115 aa, Artificial
  An artificially generated sequence
QVQLVQSGAEVKKPGASVTVSCKASGYTFTDYEMHWIRQPPGEGLEWIGAIDGKTPDTAYEQKFKGRVTLTADKSTSTAYMELSSLTSEDTAVYYCTRFYSYTYWGQGTLVTVSS

SEQ ID NO: 182 - protein, 115 aa, Artificial
  An artificially generated sequence
QVQLVQSGAEVKKPGASVTVSCKASGYTFTDYEMHWIRQPPGQGLEWIGAIDGETPDTAYSQKFKGRVTLTADKSTSTAYMELSSLTSEDTAVYYCTRFYSYTYWGQGTLVTVSS

SEQ ID NO: 183 - protein, 115 aa, Artificial
  An artificially generated sequence
QVQLVQSGAEVKKPGASVKVSCKASGYTFTDYEMHWIRQPPGEGLEWIGAIDGETPDTAYSQKFKGRVTLTADKSTSTAYMELSSLTSEDTAVYYCTRFYSYTYWGQGTLVTVSS

SEQ ID NO: 184 - protein, 115 aa, Artificial
  An artificially generated sequence
QVQLVQSGAEVKKPGASVTVSCKASGYTFTDYEMHWIRQPPGEGLEWIGAIDGETPDTAYSQKFKGRVTLTADKSTSTAYMELSSLTSEDTAVYYCTRFYSYTYWGQGTLVTVSS

SEQ ID NO: 185 - protein, 115 aa, Artificial
  An artificially generated sequence
QVQLVQSGAEVKKPGASVKVSCKASGYTFTDYEMHWIRQPPGQGLEWIGAIDGETPDTAYSESFKGRVTLTADKSTSTAYMELSSLTSEDTAVYYCTRFYSYTYWGQGTLVTVSS

SEQ ID NO: 186 - protein, 115 aa, Artificial
  An artificially generated sequence
QVQLVQSGAEVKKPGASVKVSCKASGYEFTDYEMHWIRQPPGQGLEWIGAIDGKTPDTAYSQKFKGRVTLTADKSTSTAYMELSSLTSEDTAVYYCTRFYSYTYWGQGTLVTVSS

SEQ ID NO: 187 - protein, 115 aa, Artificial
  An artificially generated sequence
QVQLVQSGAEVKKPGASVKVSCKASGYTFEDYEMHWIRQPPGQGLEWIGAIDGKTPDTAYSQKFKGRVTLTADKSTSTAYMELSSLTSEDTAVYYCTRFYSYTYWGQGTLVTVSS

SEQ ID NO: 188 - protein, 115 aa, Artificial
  An artificially generated sequence
QVQLVQSGAEVKKPGASVKVSCKASGYTFTDYEMHWIRQPPGQGLEWIGAIDGKTPDTAYSEKFKGRVTLTADKSTSTAYMELSSLTSEDTAVYYCTRFYSYTYWGQGTLVTVSS

SEQ ID NO: 189 - protein, 115 aa, Artificial
  An artificially generated sequence
QVQLVQSGAEVKKPGASVKVSCKASGYTFTDYEMHWIRQPPGQGLEWIGAIDGKTPDTAYSQKFEGRVTLTADKSTSTAYMELSSLTSEDTAVYYCTRFYSYTYWGQGTLVTVSS

SEQ ID NO: 190 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVELTADKSTSTAYMELSSLTSEDTAVYYCTRFYSYTYWGQGTLVTVSS

SEQ ID NO: 191 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELESLTSEDTAVYYCTRFYSYTYWGQGTLVTVSS

SEQ ID NO: 192 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSELTSEDTAVYYCTRFYSYTYWGQGTLVTVSS

SEQ ID NO: 193 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTEEDTAVYYCTRFYSYTYWGQGTLVTVSS

SEQ ID NO: 194 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDEAVYYCTRFYSYTYWGQGTLVTVSS

SEQ ID NO: 195 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAEYYCTRFYSYTYWGQGTLVTVSS

SEQ ID NO: 196 - protein, 115 aa, Artificial
  An artificially generated sequence
QVQLVQSGAEVKKPGASVTVSCKASGYTFTDYEMHWIRQPPGEGLEWIGAIDGETPDTAYEQKFKGRVTLTADKSTSTAYMELSSLTSEDTAVYYCTRFYSYTYWGQGTLVTVSS

SEQ ID NO: 197 - protein, 115 aa, Artificial
  An artificially generated sequence
QVQLVQSGAEVKKPGASVTVSCKASGYTFTDYEMHWIRQPPGEGLEWIGAIDGETPDTAYSEKFKGRVTLTADKSTSTAYMELSSLTSEDTAVYYCTRFYSYTYWGQGTLVTVSS

SEQ ID NO: 198 - protein, 115 aa, Artificial
  An artificially generated sequence
QVQLVQSGAEVKKPGASVTVSCKASGYTFTDYEMHWIRQPPGEGLEWIGAIDGETPDTAYSDKFKGRVTLTADKSTSTAYMELSSLTSEDTAVYYCTRFYSYTYWGQGTLVTVSS

SEQ ID NO: 199 - protein, 115 aa, Artificial
  An artificially generated sequence
QVQLVQSGAEVKKPGASVTVSCKASGYTFTDYEMHWIRQPPGEGLEWIGAIDGETPDTAYSQKFEGRVTLTADKSTSTAYMELSSLTSEDTAVYYCTRFYSYTYWGQGTLVTVSS

SEQ ID NO: 200 - protein, 115 aa, Artificial
  An artificially generated sequence
QVQLVQSGAEVKKPGASVTVSCKASGYTFTDYEMHWIRQPPGEGLEWIGAIDGETPDTAYSEKFEGRVTLTADKSTSTAYMELSSLTSEDTAVYYCTRFYSYTYWGQGTLVTVSS

SEQ ID NO: 201 - protein, 115 aa, Artificial
  An artificially generated sequence
QVQLVQSGAEVKKPGASVTVSCKASGYTFTDYEMHWIRQPPGEGLEWIGAIDGETPDTAYSQKFEGRVTLTADKSTSTAYMELSSLTEEDTAVYYCTRFYSYTYWGQGTLVTVSS

SEQ ID NO: 202 - protein, 115 aa, Artificial
  An artificially generated sequence
QVQLVQSGAEVKKPGASVTVSCKASGYTFEDYEMHWIRQPPGEGLEWIGAIDGETPDTAYSQKFEGRVTLTADKSTSTAYMELSSLTEEDTAVYYCTRFYSYTYWGQGTLVTVSS

SEQ ID NO: 203 - protein, 115 aa, Artificial
  An artificially generated sequence
QVQLVQSGAEVKKPGASVKVSCKASGYTFTDYEMHWVRQAPGQGLEWIGAIDGKTPDTAYSQKFKGRVTLTADKSTSTAYMELSSLTSEDTAVYYCTRFYSYTYWGQGTLVTVSS

SEQ ID NO: 204 - protein, 115 aa, Artificial
  An artificially generated sequence
QVQLVQSGAEVKKPGASVKVSCKASGYTFTDYEMHWIRQPPGQGLEWMGAIDGKTPDTAYSQKFKGRVTLTADKSTSTAYMELSSLTSEDTAVYYCTRFYSYTYWGQGTLVTVSS

SEQ ID NO: 205 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLRSEDTAVYYCTRFYSYTYWGQGTLVTVSS

SEQ ID NO: 206 - protein, 115 aa, Artificial
  An artificially generated sequence
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSS

SEQ ID NO: 207 - protein, 115 aa, Artificial
  An artificially generated sequence
QVQLVQSGAEVKKPGASVTVSCKASGYTFTDYEMHWIRQPPGEGLEWIGAIDGWTPDTAYSEKFKGRVTLTADKSTSTAYMELSSLTSEDTAVYYCTRFYSYTYWGQGTLVTVSS

SEQ ID NO: 208 - protein, 115 aa, Artificial
  An artificially generated sequence
QVQLVQSGAEVKKPGASVTVSCKASGYTFTDYEMHWIRQPPGEGLEWIGAIDGYTPDTAYSEKFKGRVTLTADKSTSTAYMELSSLTSEDTAVYYCTRFYSYTYWGQGTLVTVSS

SEQ ID NO: 209 - protein, 115 aa, Artificial
  An artificially generated sequence
QVQLVQSGAEVKKPGASVTVSCKASGYTFTDYEMHWIRQPPGEGLEWIGAIDGKTPDTAYSEKFKGRVTLTADKSTSTAYMELSSLTSEDTAVYYCTRFYSYTYWGQGTLVTVSS

SEQ ID NO: 210 - protein, 115 aa, Artificial
  An artificially generated sequence
QVQLVQSGAEVKKPGASVTVSCKASGYTFTDYEMHWIRQPPGEGLEWIGAIDGPTPDTAYSQKFEGRVTLTADKSTSTAYMELSSLTSEDTAVYYCTRFYSYTYWGQGTLVTVSS

SEQ ID NO: 211 - protein, 115 aa, Artificial
  An artificially generated sequence
QVQLVQSGAEVKKPGASVTVSCKASGYTFTDYEMHWVRQAPGEGLEWMGAIDGETPDTAYSEKFKGRVTLTADKSTSTAYMELSSLTSEDTAVYYCTRFYSYTYWGQGTLVTVSS

SEQ ID NO: 212 - protein, 115 aa, Artificial
  An artificially generated sequence
QVQLVQSGAEVKKPGASVTVSCKASGYTFTDYEMHWVRQAPGEGLEWMGAIDGPTPDTAYSEKFKGRVTLTADKSTSTAYMELSSLTSEDTAVYYCTRFYSYTYWGQGTLVTVSS

SEQ ID NO: 213 - protein, 115 aa, Artificial
  An artificially generated sequence
QVQLVQSGAEVKKPGASVTVSCKASGYTFTDYEMHWVRQAPGEGLEWMGAIDGWTPDTAYSEKFKGRVTLTADKSTSTAYMELSSLTSEDTAVYYCTRFYSYTYWGQGTLVTVSS

SEQ ID NO: 214 - protein, 115 aa, Artificial
  An artificially generated sequence
QVQLVQSGAEVKKPGASVTVSCKASGYTFTDYEMHWVRQAPGEGLEWMGAIDGYTPDTAYSEKFKGRVTLTADKSTSTAYMELSSLTSEDTAVYYCTRFYSYTYWGQGTLVTVSS

SEQ ID NO: 215 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAVYYCTRFYSYTYWGQGTLVTVSS

SEQ ID NO: 216 - protein, 112 aa, Artificial
  An artificially generated sequence
DIQMTQSPSSLSASVGDRVTITCRSSQSLVHSNRNTYLHWYQQKPGKAPKLLIYKVSNRFSGVPSRFSGSGSGTDFTFTISSLQPEDIATYYCGQGTQVPYTFGQGTKVEIK

SEQ ID NO: 217 - protein, 112 aa, Artificial
  An artificially generated sequence
DIVMTQSPLSLPVTPGEPASISCRASQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 218 - protein, 112 aa, Artificial
  An artificially generated sequence
DIVMTQSPLSLPVTPGEPASISCRISQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 219 - protein, 112 aa, Artificial
  An artificially generated sequence
DIVMTQSPLSLPVTPGEPASISCRPSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 220 - protein, 112 aa, Artificial
  An artificially generated sequence
DIVMTQSPLSLPVTPGEPASISCRTSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 221 - protein, 112 aa, Artificial
  An artificially generated sequence
DIVMTQSPLSLPVTPGEPASISCRVSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 222 - protein, 112 aa, Artificial
  An artificially generated sequence
DIVMTQSPLSLPVTPGEPASISCRSPQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 223 - protein, 112 aa, Artificial
  An artificially generated sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 224 - protein, 112 aa, Artificial
  An artificially generated sequence
DIVMTQSPLSLPVTPGEPASISCRSSQSFVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 225 - protein, 112 aa, Artificial
  An artificially generated sequence
DIVMTQSPLSLPVTPGEPASISCRSSQSIVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 226 - protein, 112 aa, Artificial
  An artificially generated sequence
DIVMTQSPLSLPVTPGEPASISCRSSQSMVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 227 - protein, 112 aa, Artificial
  An artificially generated sequence
DIVMTQSPLSLPVTPGEPASISCRSSQSPVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 228 - protein, 112 aa, Artificial
  An artificially generated sequence
DIVMTQSPLSLPVTPGEPASISCRSSQSVVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 229 - protein, 112 aa, Artificial
  An artificially generated sequence
DIVMTQSPLSLPVTPGEPASISCRSSQSLVRSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 230 - protein, 112 aa, Artificial
  An artificially generated sequence
DIVMTQSPLSLPVTPGEPASISCRSSQSLVHFNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 231 - protein, 112 aa, Artificial
  An artificially generated sequence
DIVMTQSPLSLPVTPGEPASISCRSSQSLVHHNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 232 - protein, 112 aa, Artificial
  An artificially generated sequence
DIVMTQSPLSLPVTPGEPASISCRSSQSLVHLNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 233 - protein, 112 aa, Artificial
  An artificially generated sequence
DIVMTQSPLSLPVTPGEPASISCRSSQSLVHMNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 234 - protein, 112 aa, Artificial
  An artificially generated sequence
DIVMTQSPLSLPVTPGEPASISCRSSQSLVHNNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 235 - protein, 112 aa, Artificial
  An artificially generated sequence
DIVMTQSPLSLPVTPGEPASISCRSSQSLVHPNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 236 - protein, 112 aa, Artificial
  An artificially generated sequence
DIVMTQSPLSLPVTPGEPASISCRSSQSLVHQNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 237 - protein, 112 aa, Artificial
  An artificially generated sequence
DIVMTQSPLSLPVTPGEPASISCRSSQSLVHVNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 238 - protein, 112 aa, Artificial
  An artificially generated sequence
DIVMTQSPLSLPVTPGEPASISCRSSQSLVHWNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 239 - protein, 112 aa, Artificial
  An artificially generated sequence
DIVMTQSPLSLPVTPGEPASISCRSSQSLVHSNRDTYLHWYQQKPGQAPRLLIYKVSNRFSGVPDRFSGSGSGTDFTLKISRVEAEDVGVYYCGQGTQVPYTFGQGTKLEIK

SEQ ID NO: 240 - protein, 112 aa, Artificial
  An artificially generated sequence
DIVMTQSPLSLPVTPGEPASISCRSSQSLVHSNRETYLHWYQQKPGQAPRLLIYKVSNRFSGVPDRFSGSGSGTDFTLKISRVEAEDVGVYYCGQGTQVPYTFGQGTKLEIK

SEQ ID NO: 241 - protein, 112 aa, Artificial
  An artificially generated sequence
DIVMTQSPLSLPVTPGEPASISCRSSQSLVHSNRFTYLHWYQQKPGQAPRLLIYKVSNRFSGVPDRFSGSGSGTDFTLKISRVEAEDVGVYYCGQGTQVPYTFGQGTKLEIK

SEQ ID NO: 242 - protein, 112 aa, Artificial
  An artificially generated sequence
DIVMTQSPLSLPVTPGEPASISCRSSQSLVHSNRGTYLHWYQQKPGQAPRLLIYKVSNRFSGVPDRFSGSGSGTDFTLKISRVEAEDVGVYYCGQGTQVPYTFGQGTKLEIK

SEQ ID NO: 243 - protein, 112 aa, Artificial
  An artificially generated sequence
DIVMTQSPLSLPVTPGEPASISCRSSQSLVHSNRHTYLHWYQQKPGQAPRLLIYKVSNRFSGVPDRFSGSGSGTDFTLKISRVEAEDVGVYYCGQGTQVPYTFGQGTKLEIK

SEQ ID NO: 244 - protein, 112 aa, Artificial
  An artificially generated sequence
DIVMTQSPLSLPVTPGEPASISCRSSQSLVHSNRMTYLHWYQQKPGQAPRLLIYKVSNRFSGVPDRFSGSGSGTDFTLKISRVEAEDVGVYYCGQGTQVPYTFGQGTKLEIK

SEQ ID NO: 245 - protein, 112 aa, Artificial
  An artificially generated sequence
DIVMTQSPLSLPVTPGEPASISCRSSQSLVHSNRWTYLHWYQQKPGQAPRLLIYKVSNRFSGVPDRFSGSGSGTDFTLKISRVEAEDVGVYYCGQGTQVPYTFGQGTKLEIK

SEQ ID NO: 246 - protein, 112 aa, Artificial
  An artificially generated sequence
DIVMTQSPLSLPVTPGEPASISCRSSQSLVHSNRNTYIHWYQQKPGQAPRLLIYKVSNRFSGVPDRFSGSGSGTDFTLKISRVEAEDVGVYYCGQGTQVPYTFGQGTKLEIK

SEQ ID NO: 247 - protein, 112 aa, Artificial
  An artificially generated sequence
DIVMTQSPLSLPVTPGEPASISCRSSQSLVHSNRNTYVHWYQQKPGQAPRLLIYKVSNRFSGVPDRFSGSGSGTDFTLKISRVEAEDVGVYYCGQGTQVPYTFGQGTKLEIK

SEQ ID NO: 248 - protein, 112 aa, Artificial
  An artificially generated sequence
DIVMTQSPLSLPVTPGEPASISCRSSQSLVHSNRNTYLEWYQQKPGQAPRLLIYKVSNRFSGVPDRFSGSGSGTDFTLKISRVEAEDVGVYYCGQGTQVPYTFGQGTKLEIK

SEQ ID NO: 249 - protein, 112 aa, Artificial
  An artificially generated sequence
DIVMTQSPLSLPVTPGEPASISCRSSQSLVHSNRNTYLLWYQQKPGQAPRLLIYKVSNRFSGVPDRFSGSGSGTDFTLKISRVEAEDVGVYYCGQGTQVPYTFGQGTKLEIK

SEQ ID NO: 250 - protein, 112 aa, Artificial
  An artificially generated sequence
DIVMTQSPLSLPVTPGEPASISCRSSQSLVHSNRNTYLMWYQQKPGQAPRLLIYKVSNRFSGVPDRFSGSGSGTDFTLKISRVEAEDVGVYYCGQGTQVPYTFGQGTKLEIK

SEQ ID NO: 251 - protein, 112 aa, Artificial
  An artificially generated sequence
DIVMTQSPLSLPVTPGEPASISCRSSQSLVHSNRNTYLNWYQQKPGQAPRLLIYKVSNRFSGVPDRFSGSGSGTDFTLKISRVEAEDVGVYYCGQGTQVPYTFGQGTKLEIK

SEQ ID NO: 252 - protein, 112 aa, Artificial
  An artificially generated sequence
DIVMTQSPLSLPVTPGEPASISCRSSQSLVHSNRNTYLQWYQQKPGQAPRLLIYKVSNRFSGVPDRFSGSGSGTDFTLKISRVEAEDVGVYYCGQGTQVPYTFGQGTKLEIK

SEQ ID NO: 253 - protein, 112 aa, Artificial
  An artificially generated sequence
DIVMTQSPLSLPVTPGEPASISCRSSQSLVHSNRNTYLHWYQQKPGQAPRLLIYKVSFRFSGVPDRFSGSGSGTDFTLKISRVEAEDVGVYYCGQGTQVPYTFGQGTKLEIK

SEQ ID NO: 254 - protein, 112 aa, Artificial
  An artificially generated sequence
DIVMTQSPLSLPVTPGEPASISCRSSQSLVHSNRNTYLHWYQQKPGQAPRLLIYKVSHRFSGVPDRFSGSGSGTDFTLKISRVEAEDVGVYYCGQGTQVPYTFGQGTKLEIK

SEQ ID NO: 255 - protein, 112 aa, Artificial
  An artificially generated sequence
DIVMTQSPLSLPVTPGEPASISCRSSQSLVHSNRNTYLHWYQQKPGQAPRLLIYKVSIRFSGVPDRFSGSGSGTDFTLKISRVEAEDVGVYYCGQGTQVPYTFGQGTKLEIK

SEQ ID NO: 256 - protein, 112 aa, Artificial
  An artificially generated sequence
DIVMTQSPLSLPVTPGEPASISCRSSQSLVHSNRNTYLHWYQQKPGQAPRLLIYKVSMRFSGVPDRFSGSGSGTDFTLKISRVEAEDVGVYYCGQGTQVPYTFGQGTKLEIK

SEQ ID NO: 257 - protein, 112 aa, Artificial
  An artificially generated sequence
DIVMTQSPLSLPVTPGEPASISCRSSQSLVHSNRNTYLHWYQQKPGQAPRLLIYKVSTRFSGVPDRFSGSGSGTDFTLKISRVEAEDVGVYYCGQGTQVPYTFGQGTKLEIK

SEQ ID NO: 258 - protein, 112 aa, Artificial
  An artificially generated sequence
DIVMTQSPLSLPVTPGEPASISCRSSQSLVHSNRNTYLHWYQQKPGQAPRLLIYKVSWRFSGVPDRFSGSGSGTDFTLKISRVEAEDVGVYYCGQGTQVPYTFGQGTKLEIK

SEQ ID NO: 259 - protein, 112 aa, Artificial
  An artificially generated sequence
DIVMTQSPLSLPVTPGEPASISCRSSQSLVHSNRNTYLHWYQQKPGQAPRLLIYKVSNRASGVPDRFSGSGSGTDFTLKISRVEAEDVGVYYCGQGTQVPYTFGQGTKLEIK

SEQ ID NO: 260 - protein, 112 aa, Artificial
  An artificially generated sequence
DIVMTQSPLSLPVTPGEPASISCRSSQSLVHSNRNTYLHWYQQKPGQAPRLLIYKVSNRGSGVPDRFSGSGSGTDFTLKISRVEAEDVGVYYCGQGTQVPYTFGQGTKLEIK

SEQ ID NO: 261 - protein, 112 aa, Artificial
  An artificially generated sequence
DIVMTQSPLSLPVTPGEPASISCRSSQSLVHSNRNTYLHWYQQKPGQAPRLLIYKVSNRISGVPDRFSGSGSGTDFTLKISRVEAEDVGVYYCGQGTQVPYTFGQGTKLEIK

SEQ ID NO: 262 - protein, 112 aa, Artificial
  An artificially generated sequence
DIVMTQSPLSLPVTPGEPASISCRSSQSLVHSNRNTYLHWYQQKPGQAPRLLIYKVSNRKSGVPDRFSGSGSGTDFTLKISRVEAEDVGVYYCGQGTQVPYTFGQGTKLEIK

SEQ ID NO: 263 - protein, 112 aa, Artificial
  An artificially generated sequence
DIVMTQSPLSLPVTPGEPASISCRSSQSLVHSNRNTYLHWYQQKPGQAPRLLIYKVSNRLSGVPDRFSGSGSGTDFTLKISRVEAEDVGVYYCGQGTQVPYTFGQGTKLEIK

SEQ ID NO: 264 - protein, 112 aa, Artificial
  An artificially generated sequence
DIVMTQSPLSLPVTPGEPASISCRSSQSLVHSNRNTYLHWYQQKPGQAPRLLIYKVSNRMSGVPDRFSGSGSGTDFTLKISRVEAEDVGVYYCGQGTQVPYTFGQGTKLEIK

SEQ ID NO: 265 - protein, 112 aa, Artificial
  An artificially generated sequence
DIVMTQSPLSLPVTPGEPASISCRSSQSLVHSNRNTYLHWYQQKPGQAPRLLIYKVSNRNSGVPDRFSGSGSGTDFTLKISRVEAEDVGVYYCGQGTQVPYTFGQGTKLEIK

SEQ ID NO: 266 - protein, 112 aa, Artificial
  An artificially generated sequence
DIVMTQSPLSLPVTPGEPASISCRSSQSLVHSNRNTYLHWYQQKPGQAPRLLIYKVSNRPSGVPDRFSGSGSGTDFTLKISRVEAEDVGVYYCGQGTQVPYTFGQGTKLEIK

SEQ ID NO: 267 - protein, 112 aa, Artificial
  An artificially generated sequence
DIVMTQSPLSLPVTPGEPASISCRSSQSLVHSNRNTYLHWYQQKPGQAPRLLIYKVSNRRSGVPDRFSGSGSGTDFTLKISRVEAEDVGVYYCGQGTQVPYTFGQGTKLEIK

SEQ ID NO: 268 - protein, 112 aa, Artificial
  An artificially generated sequence
DIVMTQSPLSLPVTPGEPASISCRSSQSLVHSNRNTYLHWYQQKPGQAPRLLIYKVSNRVSGVPDRFSGSGSGTDFTLKISRVEAEDVGVYYCGQGTQVPYTFGQGTKLEIK

SEQ ID NO: 269 - protein, 112 aa, Artificial
  An artificially generated sequence
DIVMTQSPLSLPVTPGEPASISCRSSQSLVHSNRNTYLHWYQQKPGQAPRLLIYKVSNRYSGVPDRFSGSGSGTDFTLKISRVEAEDVGVYYCGQGTQVPYTFGQGTKLEIK

SEQ ID NO: 270 - protein, 112 aa, Artificial
  An artificially generated sequence
DIVMTQSPLSLPVTPGEPASISCRSSQSLVHSNRNTYLHWYQQKPGQAPRLLIYKVSNRFFGVPDRFSGSGSGTDFTLKISRVEAEDVGVYYCGQGTQVPYTFGQGTKLEIK

SEQ ID NO: 271 - protein, 112 aa, Artificial
  An artificially generated sequence
DIVMTQSPLSLPVTPGEPASISCRSSQSLVHSNRNTYLHWYQQKPGQAPRLLIYKVSNRFGGVPDRFSGSGSGTDFTLKISRVEAEDVGVYYCGQGTQVPYTFGQGTKLEIK

SEQ ID NO: 272 - protein, 112 aa, Artificial
  An artificially generated sequence
DIVMTQSPLSLPVTPGEPASISCRSSQSLVHSNRNTYLHWYQQKPGQAPRLLIYKVSNRFHGVPDRFSGSGSGTDFTLKISRVEAEDVGVYYCGQGTQVPYTFGQGTKLEIK

SEQ ID NO: 273 - protein, 112 aa, Artificial
  An artificially generated sequence
DIVMTQSPLSLPVTPGEPASISCRSSQSLVHSNRNTYLHWYQQKPGQAPRLLIYKVSNRFIGVPDRFSGSGSGTDFTLKISRVEAEDVGVYYCGQGTQVPYTFGQGTKLEIK

SEQ ID NO: 274 - protein, 112 aa, Artificial
  An artificially generated sequence
DIVMTQSPLSLPVTPGEPASISCRSSQSLVHSNRNTYLHWYQQKPGQAPRLLIYKVSNRFLGVPDRFSGSGSGTDFTLKISRVEAEDVGVYYCGQGTQVPYTFGQGTKLEIK

SEQ ID NO: 275 - protein, 112 aa, Artificial
  An artificially generated sequence
DIVMTQSPLSLPVTPGEPASISCRSSQSLVHSNRNTYLHWYQQKPGQAPRLLIYKVSNRFMGVPDRFSGSGSGTDFTLKISRVEAEDVGVYYCGQGTQVPYTFGQGTKLEIK

SEQ ID NO: 276 - protein, 112 aa, Artificial
  An artificially generated sequence
DIVMTQSPLSLPVTPGEPASISCRSSQSLVHSNRNTYLHWYQQKPGQAPRLLIYKVSNRFPGVPDRFSGSGSGTDFTLKISRVEAEDVGVYYCGQGTQVPYTFGQGTKLEIK

SEQ ID NO: 277 - protein, 112 aa, Artificial
  An artificially generated sequence
DIVMTQSPLSLPVTPGEPASISCRSSQSLVHSNRNTYLHWYQQKPGQAPRLLIYKVSNRFQGVPDRFSGSGSGTDFTLKISRVEAEDVGVYYCGQGTQVPYTFGQGTKLEIK

SEQ ID NO: 278 - protein, 112 aa, Artificial
  An artificially generated sequence
DIVMTQSPLSLPVTPGEPASISCRSSQSLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 279 - protein, 112 aa, Artificial
  An artificially generated sequence
DIVMTQSPLSLPVTPGEPASISCRSSQSLVHSNRNTYLHWYQQKPGQAPRLLIYKVSNRFVGVPDRFSGSGSGTDFTLKISRVEAEDVGVYYCGQGTQVPYTFGQGTKLEIK

SEQ ID NO: 280 - protein, 112 aa, Artificial
  An artificially generated sequence
DIVMTQSPLSLPVTPGEPASISCRSSQSLVHSNRNTYLHWYQQKPGQAPRLLIYKVSNRFWGVPDRFSGSGSGTDFTLKISRVEAEDVGVYYCGQGTQVPYTFGQGTKLEIK

SEQ ID NO: 281 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCAQGTQVPYTFGQGTKLEIK

SEQ ID NO: 282 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCEQGTQVPYTFGQGTKLEIK

SEQ ID NO: 283 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCFQGTQVPYTFGQGTKLEIK

SEQ ID NO: 284 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCIQGTQVPYTFGQGTKLEIK

SEQ ID NO: 285 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCLQGTQVPYTFGQGTKLEIK

SEQ ID NO: 286 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCNQGTQVPYTFGQGTKLEIK

SEQ ID NO: 287 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCTQGTQVPYTFGQGTKLEIK

SEQ ID NO: 288 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCVQGTQVPYTFGQGTKLEIK

SEQ ID NO: 289 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 290 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQSTQVPYTFGQGTKLEIK

SEQ ID NO: 291 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQTTQVPYTFGQGTKLEIK

SEQ ID NO: 292 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQFPYTFGQGTKLEIK

SEQ ID NO: 293 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQHPYTFGQGTKLEIK

SEQ ID NO: 294 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQNPYTFGQGTKLEIK

SEQ ID NO: 295 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQPPYTFGQGTKLEIK

SEQ ID NO: 296 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQWPYTFGQGTKLEIK

SEQ ID NO: 297 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQYPYTFGQGTKLEIK

SEQ ID NO: 298 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 299 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 300 - protein, 112 aa, Artificial
  An artificially generated sequence
DIVMTQSPLSLPVTPGEPASISCRSSQSPVHSNRWTYLHWYQQKPGQAPRLLIYKVSNRFSGVPDRFSGSGSGTDFTLKISRVEAEDVGVYYCGQGTQVPYTFGQGTKLEIK

SEQ ID NO: 301 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCGQGTQVPYTFGQGTKLEIK

SEQ ID NO: 302 - protein, 112 aa, Artificial
  An artificially generated sequence
DIVMTQSPLSLPVTPGEPASISCRSSQSPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 303 - protein, 112 aa, Artificial
  An artificially generated sequence
DIVMTQSPLSLPVTPGEPASISCRSSQSPVHSNRNTYLHWYQQKPGQAPRLLIYKVSNRFWGVPDRFSGSGSGTDFTLKISRVEAEDVGVYYCGQGTQVPYTFGQGTKLEIK

SEQ ID NO: 304 - protein, 112 aa, Artificial
  An artificially generated sequence
DIVMTQSPLSLPVTPGEPASISCRSSQSPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 305 - protein, 112 aa, Artificial
  An artificially generated sequence
DIVMTQSPLSLPVTPGEPASISCRSSQSPVHSNRNTYLHWYQQKPGQAPRLLIYKVSNRFRGVPDRFSGSGSGTDFTLKISRVEAEDVGVYYCYQGTQVPYTFGQGTKLEIK

SEQ ID NO: 306 - protein, 112 aa, Artificial
  An artificially generated sequence
DIVMTQSPLSLPVTPGEPASISCRSSQSPVHSNRNTYLHWYQQKPGQAPRLLIYKVSNRFWGVPDRFSGSGSGTDFTLKISRVEAEDVGVYYCYQGTQVPYTFGQGTKLEIK

SEQ ID NO: 307 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQGTQVPYTFGQGTKLEIK

SEQ ID NO: 308 - protein, 112 aa, Artificial
  An artificially generated sequence
DIVMTQSPLSLPVTPGEPASISCRSSQSPVHSNRWTYLHWYQQKPGQAPRLLIYKVSNRFSGVPDRFSGSGSGTDFTLKISRVEAEDVGVYYCYQGTQVPYTFGQGTKLEIK

SEQ ID NO: 309 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 310 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 311 - protein, 112 aa, Artificial
  An artificially generated sequence
DIVMTQSPLSLPVTPGEPASISCRSSQSPVHSNRNTYIHWYQQKPGQAPRLLIYKVSNRFRGVPDRFSGSGSGTDFTLKISRVEAEDVGVYYCGQGTQVPYTFGQGTKLEIK

SEQ ID NO: 312 - protein, 112 aa, Artificial
  An artificially generated sequence
DIVMTQSPLSLPVTPGEPASISCRSSQPPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 313 - protein, 112 aa, Artificial
  An artificially generated sequence
DIVMTQSPLSLPVTPGEPASISCRSSQPPVHSNRNTYIHWYQQKPGQAPRLLIYKVSNRFSGVPDRFSGSGSGTDFTLKISRVEAEDVGVYYCGQGTQVPYTFGQGTKLEIK

SEQ ID NO: 314 - protein, 112 aa, Artificial
  An artificially generated sequence
DIVMTQSPLSLPVTPGEPASISCRSSQPLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 315 - protein, 112 aa, Artificial
  An artificially generated sequence
DIVMTQSPLSLPVTPGEPASISCRPSQSLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 316 - protein, 112 aa, Artificial
  An artificially generated sequence
DIVMTQSPLSLPVTPGEPASISCRSSQSLVHSNRNTYLHWYQQKPGQAPRLLIYKVSNRFRGVPDRFSGSGSGTDFTLKISRVEAEDVGVYYCYQGTQVPYTFGQGTKLEIK

SEQ ID NO: 317 - protein, 112 aa, Artificial
  An artificially generated sequence
DIVMTQSPLSLPVTPGEPASISCRSSQSLVHSNRNTYIHWYQQKPGQAPRLLIYKVSNRFRGVPDRFSGSGSGTDFTLKISRVEAEDVGVYYCGQGTQVPYTFGQGTKLEIK

SEQ ID NO: 318 - protein, 112 aa, Artificial
  An artificially generated sequence
DIVMTQSPLSLPVTPGEPASISCRSSQPLVHSNRNTYLHWYQQKPGQAPRLLIYKVSNRFRGVPDRFSGSGSGTDFTLKISRVEAEDVGVYYCYQGTQVPYTFGQGTKLEIK

SEQ ID NO: 319 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCYQGTQVPYTFGQGTKLEIK

SEQ ID NO: 320 - protein, 112 aa, Artificial
  An artificially generated sequence
DIVMTQSPLSLPVTPGEPASISCRSSQSPVHSNRNTYIHWYQQKPGQAPRLLIYKVSNRLSGVPDRFSGSGSGTDFTLKISRVEAEDVGVYYCYQGTQVPYTFGQGTKLEIK

SEQ ID NO: 321 - protein, 112 aa, Artificial
  An artificially generated sequence
DIVMTQSPLSLPVTPGEPASISCRSSQSPVHSNRNTYIHWYQQKPGQAPRLLIYKVSNRFPGVPDRFSGSGSGTDFTLKISRVEAEDVGVYYCYQGTQVPYTFGQGTKLEIK

SEQ ID NO: 322 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCIQGTQVPYTFGQGTKLEIK

SEQ ID NO: 323 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCLQGTQVPYTFGQGTKLEIK

SEQ ID NO: 324 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCVQGTQVPYTFGQGTKLEIK

SEQ ID NO: 325 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQSTQVPYTFGQGTKLEIK

SEQ ID NO: 326 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQTTQVPYTFGQGTKLEIK

SEQ ID NO: 327 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQGTQWPYTFGQGTKLEIK

SEQ ID NO: 328 - protein, 112 aa, Artificial
  An artificially generated sequence
DIVMTQSPLSLPVTPGEPASISCRSSESLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 329 - protein, 112 aa, Artificial
  An artificially generated sequence
DIVMTQSPLSLPVTPGEPASISCRSSQELVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 330 - protein, 112 aa, Artificial
  An artificially generated sequence
DIVMTQSPLSLPVTPGEPASISCRSSQEPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 331 - protein, 112 aa, Artificial
  An artificially generated sequence
DIVMTQSPLSLPVTPGEPASISCRSSQEPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 332 - protein, 112 aa, Artificial
  An artificially generated sequence
DIVMTQSPLSLPVTPGEPASISCRSSQEPVHSNRNTYLHWYQQKPGQAPRLLIYKVSNRFWGVPDRFSGSGSGTDFTLKISRVEAEDVGVYYCYQGTQVPYTFGQGTKLEIK

SEQ ID NO: 333 - protein, 112 aa, Artificial
  An artificially generated sequence
DIVMTQSPLSLPVTPGEPASISCRSSQEPVHSNRNTYIHWYQQKPGQAPRLLIYKVSNRFSGVPDRFSGSGSGTDFTLKISRVEAEDVGVYYCYQGTQVPYTFGQGTKLEIK

SEQ ID NO: 334 - protein, 112 aa, Artificial
  An artificially generated sequence
DIVMTQSPLSLPVTPGEPASISCRSSEPPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 335 - protein, 112 aa, Artificial
  An artificially generated sequence
DIVMTQSPLSLPVTPGEPASISCRSSESPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 336 - protein, 112 aa, Artificial
  An artificially generated sequence
DIVMTQSPLSLPVTPGEPASISCRSSESPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 337 - protein, 112 aa, Artificial
  An artificially generated sequence
DIVMTQSPLSLPVTPGEPASISCRSSESPVHSNRNTYLHWYQQKPGQAPRLLIYKVSNRFWGVPDRFSGSGSGTDFTLKISRVEAEDVGVYYCYQGTQVPYTFGQGTKLEIK

SEQ ID NO: 338 - protein, 112 aa, Artificial
  An artificially generated sequence
DIVMTQSPLSLPVTPGEPASISCRSSESPVHSNRNTYIHWYQQKPGQAPRLLIYKVSNRFSGVPDRFSGSGSGTDFTLKISRVEAEDVGVYYCYQGTQVPYTFGQGTKLEIK

SEQ ID NO: 339 - protein, 112 aa, Artificial
  An artificially generated sequence
DIVMTQSPLSLPVTPGEPASISCRSSEPPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 340 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCSQGTQVPYTFGQGTKLEIK

SEQ ID NO: 341 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCIQGTQVPYTFGQGTKLEIK

SEQ ID NO: 342 - protein, 112 aa, Artificial
  An artificially generated sequence
DIVMTQSPLSLPVTPGEPASISCRPSQSPVHSNRNTYIQWYQQKPGQAPRLLIYKVSNRFSGVPDRFSGSGSGTDFTLKISRVEAEDVGVYYCYQGTQVPYTFGQGTKLEIK

SEQ ID NO: 343 - protein, 112 aa, Artificial
  An artificially generated sequence
DIVMTQSPLSLPVTPGEPASISCRPSQSPVHSNRNTYIQWYQQKPGQAPRLLIYKVSNRFSGVPDRFSGSGSGTDFTLKISRVEAEDVGVYYCSQGTQVPYTFGQGTKLEIK

SEQ ID NO: 344 - protein, 112 aa, Artificial
  An artificially generated sequence
DIVMTQSPLSLPVTPGEPASISCRPSQSPVHSNRNTYIQWYQQKPGQAPRLLIYKVSNRFSGVPDRFSGSGSGTDFTLKISRVEAEDVGVYYCIQGTQVPYTFGQGTKLEIK

SEQ ID NO: 345 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCTQGTQVPYTFGQGTKLEIK

SEQ ID NO: 346 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCTQGTQVPYTFGQGTKLEIK

SEQ ID NO: 347 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCTQGTQVPYTFGQGTKLEIK

SEQ ID NO: 348 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCTQGTQVPYTFGQGTKLEIK

SEQ ID NO: 349 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCAQGTQVPYTFGQGTKLEIK

SEQ ID NO: 350 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCAQGTQVPYTFGQGTKLEIK

SEQ ID NO: 351 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCAQGTQVPYTFGQGTKLEIK

SEQ ID NO: 352 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCAQGTQVPYTFGQGTKLEIK

SEQ ID NO: 353 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCVQGTQVPYTFGQGTKLEIK

SEQ ID NO: 354 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCVQGTQVPYTFGQGTKLEIK

SEQ ID NO: 355 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCVQGTQVPYTFGQGTKLEIK

SEQ ID NO: 356 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCGQGTQVPYTFGQGTKLEIK

SEQ ID NO: 357 - protein, 112 aa, Artificial
  An artificially generated sequence
DIVMTQSPLSLPVTPGEPASISCRSSQSLVHSNRQTYLHWYQQKPGQAPRLLIYKVSNRFSGVPDRFSGSGSGTDFTLKISRVEAEDVGVYYCGQGTQVPYTFGQGTKLEIK

SEQ ID NO: 358 - protein, 112 aa, Artificial
  An artificially generated sequence
DIVMTQSPLSLPVTPGEPASISCRSSQPPVHSNRQTYLHWYQQKPGQAPRLLIYKVSNRFSGVPDRFSGSGSGTDFTLKISRVEAEDVGVYYCGQGTQVPYTFGQGTKLEIK

SEQ ID NO: 359 - protein, 112 aa, Artificial
  An artificially generated sequence
DIVMTQSPLSLPVTPGEPASISCRSSQPLVHSNRQTYLHWYQQKPGQAPRLLIYKVSNRFSGVPDRFSGSGSGTDFTLKISRVEAEDVGVYYCGQGTQVPYTFGQGTKLEIK

SEQ ID NO: 360 - protein, 112 aa, Artificial
  An artificially generated sequence
DIVMTQSPLSLPVTPGEPASISCQASESLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 361 - protein, 112 aa, Artificial
  An artificially generated sequence
DIVMTQSPLSLPVTPGEPASISCRSSQSLVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 362 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKVEIE

SEQ ID NO: 363 - protein, 112 aa, Artificial
  An artificially generated sequence
DIVMTQSPLSLPVTPGEPASISCQASESLVHSNRNTYLHWYQQKPGQAPRLLIYKVSNRFSGVPDRFSGSGSGTDFTLKISRVEAEDVGVYYCGQGTQVPYTFGQGTKVEIE

SEQ ID NO: 364 - protein, 112 aa, Artificial
  An artificially generated sequence
DIVMTQSPLSLPVTPGEPASISCRSSQSLVHSNRNTYLHWYLQKPGQSPQLLIYKVSNRFSGVPDRFSGSGSGTDFTLKISRVEAEDVGVYYCGQGTQVPYTFGQGTKVEIE

SEQ ID NO: 365 - protein, 112 aa, Artificial
  An artificially generated sequence
DIVMTQSPLSLPVTPGEPASISCQASESLVHSNRNTYLHWYLQKPGQSPQLLIYKVSNRFSGVPDRFSGSGSGTDFTLKISRVEAEDVGVYYCGQGTQVPYTFGQGTKVEIE

SEQ ID NO: 366 - protein, 112 aa, Artificial
  An artificially generated sequence
DIVMTQSPLSLPVTPGEPASISCQASESLVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 367 - protein, 112 aa, Artificial
  An artificially generated sequence
DIVMTQSPLSLPVTPGEPASISCQASESLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 368 - protein, 112 aa, Artificial
  An artificially generated sequence
DIVMTQSPLSLPVTPGEPASISCRSSQSLVHSNRNTYLHWYLQKPGQSPQLLIYKVSNRFRGVPDRFSGSGSGTDFTLKISRVEAEDVGVYYCGQGTQVPYTFGQGTKLEIK

SEQ ID NO: 369 - protein, 112 aa, Artificial
  An artificially generated sequence
DIVMTQSPLSLPVTPGEPASISCRSSQSLVHSNRNTYLHWYQQKPGQAPRLLIYKVSNRFRGVPDRFSGSGSGTDFTLKISRVEAEDVGVYYCGQGTQVPYTFGQGTKVEIE

SEQ ID NO: 370 - protein, 112 aa, Artificial
  An artificially generated sequence
DIVMTQSPLSLPVTPGEPASISCQASESLVHSNRNTYLHWYQQKPGQAPRLLIYKVSNRFRGVPDRFSGSGSGTDFTLKISRVEAEDVGVYYCGQGTQVPYTFGQGTKVEIE

SEQ ID NO: 371 - protein, 112 aa, Artificial
  An artificially generated sequence
DIVMTQSPLSLPVTPGEPASISCRSSQSLVHSNRNTYLHWYLQKPGQSPQLLIYKVSNRFRGVPDRFSGSGSGTDFTLKISRVEAEDVGVYYCGQGTQVPYTFGQGTKVEIE

SEQ ID NO: 372 - protein, 112 aa, Artificial
  An artificially generated sequence
DIVMTQSPLSLPVTPGEPASISCQASESLVHSNRNTYLHWYLQKPGQSPQLLIYKVSNRFRGVPDRFSGSGSGTDFTLKISRVEAEDVGVYYCGQGTQVPYTFGQGTKVEIE

SEQ ID NO: 373 - protein, 112 aa, Artificial
  An artificially generated sequence
DIVMTQSPLSLPVTPGEPASISCRSSQSPVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 374 - protein, 112 aa, Artificial
  An artificially generated sequence
DIVMTQSPLSLPVTPGEPASISCRSSQSPVHSNRNTYLHWYLQKPGQSPQLLIYKVSNRFSGVPDRFSGSGSGTDFTLKISRVEAEDVGVYYCYQGTQVPYTFGQGTKLEIK

SEQ ID NO: 375 - protein, 112 aa, Artificial
  An artificially generated sequence
DIVMTQSPLSLPVTPGEPASISCRSSQSPVHSNRNTYIQWYLQKPGQSPQLLIYKVSNRFSGVPDRFSGSGSGTDFTLKISRVEAEDVGVYYCYQGTQVPYTFGQGTKLEIK

SEQ ID NO: 376 - protein, 112 aa, Artificial
  An artificially generated sequence
DIVMTQSPLSLPVTPGEPASISCQASESPVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 377 - protein, 112 aa, Artificial
  An artificially generated sequence
DIVMTQSPLSLPVTPGEPASISCQASESPVHSNRNTYLHWYLQKPGQSPQLLIYKVSNRFSGVPDRFSGSGSGTDFTLKISRVEAEDVGVYYCYQGTQVPYTFGQGTKLEIK

SEQ ID NO: 378 - protein, 112 aa, Artificial
  An artificially generated sequence
DIVMTQSPLSLPVTPGEPASISCQASESPVHSNRNTYIQWYLQKPGQSPQLLIYKVSNRFSGVPDRFSGSGSGTDFTLKISRVEAEDVGVYYCYQGTQVPYTFGQGTKLEIK

SEQ ID NO: 379 - protein, 112 aa, Artificial
  An artificially generated sequence
DIVMTQSPLSLPVTPGEPASISCRSSQSPVHSNRNTYLHWYLQKPGQSPQLLIYKVSNRFSGVPDRFSGSGSGTDFTLKISRVEAEDVGVYYCTQGTQVPYTFGQGTKLEIK

SEQ ID NO: 380 - protein, 112 aa, Artificial
  An artificially generated sequence
DIVMTQSPLSLPVTPGEPASISCQASESPVHSNRNTYLHWYLQKPGQSPQLLIYKVSNRFSGVPDRFSGSGSGTDFTLKISRVEAEDVGVYYCTQGTQVPYTFGQGTKLEIK

SEQ ID NO: 381 - protein, 458 aa, Artificial
  An artificially generated sequence
QVQLVESGGGVVQPGRSLRLSCAASGFTFSNAWMHWVRQAPGKGLEWVANIKAKSNNYATYYAESVKGRFTISRDDSKNSLYLQMNSLKTEDTAVYYCRYVHYGAYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 382 - protein, 458 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYAYYGVQAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 383 - protein, 458 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYYYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 384 - protein, 440 aa, Artificial
  An artificially generated sequence
QVQLVQSGAEVKKPGASVTVSCKASGYTFTDYEMHWIRQPPGEGLEWIGAIDGETPDTAYSEKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 385 - protein, 440 aa, Artificial
  An artificially generated sequence
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 386 - protein, 440 aa, Artificial
  An artificially generated sequence
QVQLVQSGAEVKKPGASVTVSCKASGYTFTDYEMHWVRQAPGEGLEWMGAIDGETPDTAYSEKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 387 - protein, 440 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 388 - protein, 458 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 389 - protein, 458 aa, Artificial; identical to SEQ ID NO: 49
  An artificially generated sequence

SEQ ID NO: 390 - protein, 447 aa, Artificial
  An artificially generated sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 391 - protein, 458 aa, Artificial
  An artificially generated sequence
QVQLVESGGGVVQPGRSLRLSCAASGFTFSNAWMHWVRQAPGKGLEWVAQIKAKSNNYKKYYAESVKGRFTISRDDSKNSLYLQMNSLKTEDTAVYYCRYVHYYYYYGVQAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 392 - protein, 458 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 393 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 394 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAASYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 395 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 396 - protein, 447 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 397 - protein, 447 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAASYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 398 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 399 - protein, 447 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 400 - protein, 447 aa, Artificial
  An artificially generated sequence
QVQLVESGGGLVQPGRSLRLSCAASGFTFSNAWMHWVRQAPGKGLEWVAQIKDKSQNYATYVAESVKGRFTISRDDSKNSLYLQMNSLKTEDTAVYYCRYVHYAAGYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 401 - protein, 447 aa, Artificial
  An artificially generated sequence
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 402 - protein, 447 aa, Artificial
  An artificially generated sequence
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 403 - protein, 450 aa, Artificial; identical to SEQ ID NO: 47
  An artificially generated sequence

SEQ ID NO: 404 - protein, 450 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPHHHHHHHH

SEQ ID NO: 405 - protein, 222 aa, Artificial; identical to SEQ ID NO: 48
  An artificially generated sequence

SEQ ID NO: 406 - protein, 222 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAVYYCTRFYSYTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 407 - protein, 219 aa, Artificial; identical to SEQ ID NO: 50
  An artificially generated sequence

SEQ ID NO: 408 - protein, 219 aa, Artificial
  An artificially generated sequence
DIVMTQSPLSLPVTPGEPASISCRSSQSLVHSNRNTYLSWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 219 aa, Artificial; identical to SEQ ID NO: 56
  An artificially generated sequence

SEQ ID NO: 410 - protein, 219 aa, Artificial
  An artificially generated sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 411 - protein, 219 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 412 - protein, 219 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 413 - protein, 219 aa, Artificial
  An artificially generated sequence
DIVMTQSPLSLPVTPGEPASISCRSSQSPVHSNRNTYLHWYQQKPGQAPRLLIYKVSNRFRGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 414 - protein, 219 aa, Artificial
  An artificially generated sequence
DIVMTQSPLSLPVTPGEPASISCRSSQSPVHSNRNTYLHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 415 - protein, 219 aa, Artificial
  An artificially generated sequence
DIVMTQSPLSLPVTPGEPASISCRSSQSPVHSNRNTYLHWYQQKPGQAPRLLIYKVSNRFWGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 219 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 219 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - protein, 219 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 219 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 420 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYYYYGVQAWGQGTTVTVSS

SEQ ID NO: 421 - protein, 122 aa, Artificial
  An artificially generated sequence
QVQLVESGGGVVQPGRSLRLSCAASGFTFSNAWMHWVRQAPGKGLEWVAQIKAKSNNYKKYYAESVKGRFTISRDDSKNSLYLQMNSLKTEDTAVYYCRYVHYYYYYGVQAWGQGTTVTVSS

SEQ ID NO: 422 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRRVHYGAYYGVDAWGQGTTVTVSS

SEQ ID NO: 423 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRRVHYYYYYGVDAWGQGTTVTVSS

SEQ ID NO: 424 - protein, 122 aa, Artificial; identical to SEQ ID NO: 42
  An artificially generated sequence

SEQ ID NO: 425 - protein, 122 aa, Artificial
  An artificially generated sequence
QVQLVESGGGVVQPGRSLRLSCAASGFTFSNAWMHWVRQAPGKGLEWVALIKAKSNNYATYYAESVKGRFTISRDDSKNSLYLQMNSLKTEDTAVYYCRYVHYGAYYGVDAWGQGTTVTVSS

SEQ ID NO: 426 - protein, 122 aa, Artificial
  An artificially generated sequence
QVQLVESGGGVVQPGRSLRLSCAASGFTFSNAWMHWVRQAPGKGLEWVANIKAKSNNYATYYAESVKGRFTISRDDSKNSLYLQMNSLKTEDTAVYYCRYVHYGAYYGVDAWGQGTTVTVSS

SEQ ID NO: 427 - protein, 122 aa, Artificial
  An artificially generated sequence
QVQLVESGGGVVQPGRSLRLSCAASGFTFSNAWMHWVRQAPGKGLEWVAQIKALSNNYATYYAESVKGRFTISRDDSKNSLYLQMNSLKTEDTAVYYCRYVHYGAYYGVDAWGQGTTVTVSS

SEQ ID NO: 428 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYAYYGVDAWGQGTTVTVSS

SEQ ID NO: 429 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYAYYGVQAWGQGTTVTVSS

SEQ ID NO: 430 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYYYYGVDAWGQGTTVTVSS

SEQ ID NO: 431 - protein, 122 aa, Artificial
  An artificially generated sequence
QVQLVESGGGVVQPGRSLRLSCAASGFTFSNAWMHWVRQAPGKGLEWVAQIKAKSNNYKKYYAESVKGRFTISRDDSKNSLYLQMNSLKTEDTAVYYCRYVHYYYYYGVDAWGQGTTVTVSS

SEQ ID NO: 432 - protein, 107 aa, Artificial
  An artificially generated sequence
ASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 433 - protein, 115 aa, Artificial; identical to SEQ ID NO: 40
  An artificially generated sequence

SEQ ID NO: 434 - protein, 122 aa, Artificial; identical to SEQ ID NO: 42
  An artificially generated sequence

SEQ ID NO: 435 - protein, 112 aa, Artificial; identical to SEQ ID NO: 53
  An artificially generated sequence

SEQ ID NO: 436 - DNA, 20 bp, Artificial
  An artificially generated sequence
tatcagagcttggttgacgg

SEQ ID NO: 437 - DNA, 32 bp, Artificial
  An artificially generated sequence
actcgttgtggcttagaagcagtaacaatacc

SEQ ID NO: 438 - DNA, 30 bp, Artificial
  An artificially generated sequence
actgtaatcctagtacttaggaggctgagg

SEQ ID NO: 439 - DNA, 26 bp, Artificial
  An artificially generated sequence
aatccatcttgttcaatggccgatcc

SEQ ID NO: 440 - DNA, 30 bp, Artificial
  An artificially generated sequence
tagcagccttcagatgaagaggtaggactc

SEQ ID NO: 441 - DNA, 28 bp, Artificial
  An artificially generated sequence
ttgatgtgccacctcactgctgcactgg

SEQ ID NO: 442 - DNA, 24 bp, Artificial
  An artificially generated sequence
aactgacaatgggacatcagctga

SEQ ID NO: 443 - DNA, 24 bp, Artificial
  an artificially generated sequence
atgggactgttactttactaagat

SEQ ID NO: 444 - DNA, 28 bp, Artificial
  an artificially generated sequence
aagaaatgggtggtattacacagacacc

SEQ ID NO: 445 - DNA, 31 bp, Artificial
  an artificially generated sequence
tgggccagcgggaggcagtgttctccagagg

SEQ ID NO: 446 - DNA, 29 bp, Artificial
  an artificially generated sequence
tagttcggtgacctggctttatctactgg

SEQ ID NO: 447 - DNA, 31 bp, Artificial
  An artificially generated sequence
atggctgcttctagaagccaccagtctcagg

SEQ ID NO: 448 - DNA, 26 bp, Artificial
  An artificially generated sequence
tgctccacgcttttgccggaggacag

SEQ ID NO: 449 - DNA, 25 bp, Artificial
  An artificially generated sequence
taggaggagaacacctggactactc

SEQ ID NO: 450 - DNA, 28 bp, Artificial
  An artificially generated sequence
agcattctgagaggatgcggtggaacac

SEQ ID NO: 451 - DNA, 29 bp, Artificial
  An artificially generated sequence
tgctcggagggctggatctgggtccacag

SEQ ID NO: 452 - DNA, 29 bp, Artificial
  An artificially generated sequence
tcatcctgtggcttgcctctatttgttgc

SEQ ID NO: 453 - DNA, 29 bp, Artificial
  An artificially generated sequence
ttgctatggcactttgagaaacctccatc

SEQ ID NO: 454 - DNA, 26 bp, Artificial
  An artificially generated sequence
aatacttctactggagaagcaaagag

SEQ ID NO: 455 - DNA, 27 bp, Artificial
  An artificially generated sequence
tagttgcatttagaggacttattatgc

SEQ ID NO: 456 - protein, 5 aa, Artificial
  An artificially generated sequence
DYEMH

SEQ ID NO: 457 - protein, 17 aa, Artificial
  An artificially generated sequence
AIDGPTPDTAYSEKFKG

SEQ ID NO: 458 - protein, 6 aa, Artificial
  An artificially generated sequence
FYSYTY

SEQ ID NO: 459 - protein, 7 aa, Artificial
  An artificially generated sequence
GYTFTDY

SEQ ID NO: 460 - protein, 6 aa, Artificial
  An artificially generated sequence
DGPTPD

SEQ ID NO: 461 - protein, 8 aa, Artificial
  An artificially generated sequence
TRFYSYTY

SEQ ID NO: 462 - protein, 6 aa, Artificial
  An artificially generated sequence
TDYEMH

SEQ ID NO: 463 - protein, 13 aa, Artificial
  An artificially generated sequence
WIGAIDGPTPDTA

SEQ ID NO: 464 - protein, 7 aa, Artificial
  An artificially generated sequence
TRFYSYT

SEQ ID NO: 465 - protein, 5 aa, Artificial
  An artificially generated sequence
NAWMH

SEQ ID NO: 466 - protein, 19 aa, Artificial
  An artificially generated sequence
QIKDKSQNYATYVAESVKG

SEQ ID NO: 467 - protein, 11 aa, Artificial
  An artificially generated sequence
VHYAAGYGVDI

SEQ ID NO: 468 - protein, 7 aa, Artificial
  An artificially generated sequence
GFTFSNA

SEQ ID NO: 469 - protein, 8 aa, Artificial
  An artificially generated sequence
KDKSQNYA

SEQ ID NO: 470 - protein, 13 aa, Artificial
  An artificially generated sequence
RYVHYAAGYGVDI

SEQ ID NO: 471 - protein, 6 aa, Artificial
  An artificially generated sequence
SNAWMH

SEQ ID NO: 472 - protein, 15 aa, Artificial
  An artificially generated sequence
WVAQIKDKSQNYATY

SEQ ID NO: 473 - protein, 12 aa, Artificial
  An artificially generated sequence
RYVHYAAGYGVD

SEQ ID NO: 474 - protein, 16 aa, Artificial
  An artificially generated sequence
RSSQPLVHSNRNTYLH

SEQ ID NO: 475 - protein, 7 aa, Artificial
  An artificially generated sequence
KVSNRFS

SEQ ID NO: 476 - protein, 9 aa, Artificial
  An artificially generated sequence
GQGTQVPYT

SEQ ID NO: 477 - protein, 7 aa, Artificial
  An artificially generated sequence
NTYLHWY

SEQ ID NO: 478 - protein, 6 aa, Artificial
  An artificially generated sequence
LLIYKV

SEQ ID NO: 479 - protein, 8 aa, Artificial
  An artificially generated sequence
GQGTQVPY

The invention claimed is:

1. A method for treating glypican-3 positive cancer, for inducing cytotoxicity, for suppressing cell proliferation, for inhibiting cell proliferation, or for activating immune response in an individual having glypican-3 positive cancer, comprising administering an effective amount of a bispecific antibody that comprises an antibody variable region having glypican 3-binding activity and an antibody variable region having CD3-binding activity, wherein the antibody variable region having glypican 3-binding activity and the antibody variable region having CD3-binding activity comprise a common light chain variable region respectively, and wherein
 (a) the antibody variable region having glypican 3-binding activity comprises heavy chain variable region complementarity-determining region (CDR) 1, CDR2, and CDR3 comprising the amino acid sequences of the CDR1, CDR2, and CDR3 regions comprised in SEQ ID NO: 206, respectively;
 (b) the antibody variable region having CD3-binding activity comprises heavy chain variable region CDR1, CDR2, and CDR3 comprising the amino acid sequences of the CDR1, CDR2, and CDR3 regions comprised in SEQ ID NO: 168, respectively; and
 (c) the common light chain variable region comprises CDR1, CDR2, and CDR3 comprising the amino acid sequences of the CDR1, CDR2, and CDR3 regions comprised in SEQ ID NO: 223, respectively.

2. The method of claim 1, wherein the bispecific antibody comprises the antibody heavy chain of SEQ ID NO: 385, the antibody heavy chain of SEQ ID NO: 402, and the common light chain of SEQ ID NO: 410.

3. The method of claim 1, wherein the glypican 3-positive cancer is a cancer in which the number of glypican 3 antigens on cell surface per cell is 100 or more.

4. The method of claim 1, wherein the cancer is any cancer selected from the group consisting of gastric cancer, head and neck cancer, esophageal cancer, lung cancer, liver cancer, ovary cancer, breast cancer, colon cancer, kidney cancer, skin cancer, muscle tumor, pancreas cancer, prostate cancer, testis cancer, uterine cancer, cholangiocarcinoma, Merkel cell carcinoma, bladder cancer, thyroid cancer, schwannoma, adrenal cancer, anus cancer, central nervous system tumor, neuroendocrine tissue tumor, penis cancer, pleura tumor, salivary gland tumor, vulva cancer, thymoma, and childhood cancer.

5. The method of claim 1, wherein the cancer is refractory to treatment with an immune checkpoint inhibitor.

6. The method of claim 1 further comprising administering an effective amount of another anticancer agent.

7. The method of claim 6, wherein the bispecific antibody is administered simultaneously with said another anticancer agent.

8. The method of claim 6, wherein the bispecific antibody is administered before or after administration of said another anticancer agent.

9. The method of claim 6, wherein said another anticancer agent is a chemotherapeutic agent, a T cell-activating agonist agent, an immune checkpoint inhibitor, or an angiogenic inhibitor.

10. The method of claim 9, wherein the chemotherapeutic agent is an antimetabolite, a plant alkaloid, or a platinum compound.

11. The method of claim 9, wherein the immune checkpoint inhibitor is an anti-PD1 antibody, an anti-PDL1 antibody, an anti-CTLA-4 antibody, an anti-TIM3 antibody, or an anti-LAG3 antibody.

12. The method of claim 9, wherein the angiogenic inhibitor is bevacizumab.

13. The method of claim 1, wherein
 (a) the antibody variable region having glypican 3-binding activity comprises a heavy chain variable region comprising a sequence having at least 80% identity to the amino acid sequence of SEQ ID NO: 206;
 (b) the antibody variable region having CD3-binding activity comprises a heavy chain variable region comprising a sequence having at least 80% identity to the amino acid sequence of SEQ ID NO: 168; and
 (c) the common light chain variable region comprises a sequence having at least 80% identity to the amino acid sequence of SEQ ID NO: 223.

14. The method of claim 1, wherein the bispecific antibody comprises
 (a) an antibody heavy chain comprising a sequence having at least 80% identity to the amino acid sequence of SEQ ID NO: 385;
 (b) an antibody heavy chain comprising a sequence having at least 80% identity to the amino acid sequence of SEQ ID NO: 402; and
 (c) a common light chain comprising a sequence having at least 80% identity to the amino acid sequence of SEQ ID NO: 410.

15. The method of claim 4, wherein the cancer is liver cancer.

16. The method of claim 10, wherein the antimetabolite is capecitabine, the plant alkaloid is paclitaxel, and the platinum compound is cisplatin.

17. A kit comprising:
 (A) a pharmaceutical composition comprising a bispecific antibody;
 (B) a container; and
 (C) an instruction or a label indicating that the bispecific antibody and at least one type of another anticancer agent are administered in combination to an individual for treating glypican-3 positive cancer in the individual, wherein the bispecific antibody comprises an antibody variable region having glypican 3-binding activity and an antibody variable region having CD3-binding activity, wherein the antibody variable region having glypican 3-binding activity and the antibody variable region having CD3-binding activity comprise a common light chain variable region, respectively, and wherein (a) the antibody variable region having glypican 3-binding activity comprises heavy chain variable region complementarity-determining region (CDR) 1, CDR2, and CDR3 comprising the amino acid sequences of the CDR1, CDR2, and CDR3 regions comprised in SEQ ID NO: 206, respectively; (b) the antibody variable region having CD3-binding activity comprises heavy chain variable region CDR1, CDR2, and CDR3 comprising the amino acid sequences of the CDR1, CDR2, and CDR3 regions comprised in SEQ ID NO: 168, respectively; and (c) the common light chain variable region comprises CDR1, CDR2, and CDR3 comprising the amino acid sequences of the CDR1, CDR2, and CDR3 regions comprised in SEQ ID NO: 223, respectively.

\* \* \* \* \*